(12) United States Patent
De Souza et al.

(10) Patent No.: US 8,785,162 B2
(45) Date of Patent: Jul. 22, 2014

(54) AMINOTRANSFERASE AND OXIDOREDUCTASE NUCLEIC ACIDS AND POLYPEPTIDES AND METHODS OF USING

(75) Inventors: Mervyn L. De Souza, Fort Collins, CO (US); Paula M. Hicks, Bend, OR (US); Sherry R. Kollmann, Maple Grove, MN (US); Jose Laplaza, San Diego, CA (US); Joshua M. Lundorff, Minneapolis, MN (US); Sara C. McFarlan, St. Paul, MN (US); Erin Marasco, Minneapolis, MN (US); Wei Niu, San Diego, CA (US); Fernando A. Sanchez-Riera, San Carlos, CA (US); Christopher Solheid, Minneapolis, MN (US); David P. Weiner, Del Mar, CA (US); Peter Luginbuhl, San Diego, CA (US); Analia Bueno, San Diego, CA (US); Joslin Cuenca, San Diego, CA (US)

(73) Assignee: Cargill, Incorporated, Wayzata, MN (US)

( * ) Notice: Subject to any disclaimer, the term of this patent is extended or adjusted under 35 U.S.C. 154(b) by 753 days.

(21) Appl. No.: 12/811,491

(22) PCT Filed: Dec. 31, 2008

(86) PCT No.: PCT/US2008/014137
§ 371 (c)(1),
(2), (4) Date: Oct. 4, 2010

(87) PCT Pub. No.: WO2009/088482
PCT Pub. Date: Jul. 16, 2009

(65) Prior Publication Data
US 2011/0020882 A1   Jan. 27, 2011

Related U.S. Application Data

(60) Provisional application No. 61/018,814, filed on Jan. 3, 2008.

(51) Int. Cl.
| | |
|---|---|
| *C12P 17/10* | (2006.01) |
| *C12P 13/22* | (2006.01) |
| *C12P 13/04* | (2006.01) |
| *C12N 9/10* | (2006.01) |
| *C12P 21/06* | (2006.01) |
| *C12P 19/34* | (2006.01) |
| *C12N 1/20* | (2006.01) |
| *C07H 21/04* | (2006.01) |
| *C07K 1/00* | (2006.01) |

(52) U.S. Cl.
USPC ........... 435/121; 435/108; 435/106; 435/193; 435/69.1; 435/91.1; 435/252.3; 536/23.1; 536/23.2; 530/350

(58) Field of Classification Search
USPC ............... 435/121, 108, 106, 193, 69.1, 91.1, 435/252.3; 536/23.1, 23.2; 530/350
See application file for complete search history.

(56) References Cited

U.S. PATENT DOCUMENTS 7,582,455 B2 * 9/2009 Brazeau et al. ............... 435/121

OTHER PUBLICATIONS

Broun et al., Catalytic plasticity of fatty acid modification enzymes underlying chemical diversity of plant lipids. Science, 1998, vol. 282: 1315-1317.*
Chica et al., Semi-rational approaches to engineering enzyme activity: combining the benefits of directed evolution and rational design. Curr. Opi. Biotechnol., 2005, vol. 16: 378-384.*
Devos et al., Practical limits of function prediction. Proteins: Structure, Function, and Genetics. 2000, vol. 41: 98-107.*
Sen et al., Developments in directed evolution for improving enzyme functions. Appl. Biochem. Biotechnol., 2007, vol. 143: 212-223.*
Whisstock et al., Prediction of protein function from protein sequence. Q. Rev. Biophysics., 2003, vol. 36 (3): 307-340.*
Wishart et al., A single mutation converts a novel phosphotyrosine binding domain into a dual-specificity phosphatase. J. Biol. Chem., 1995, vol. 270(45): 26782-26785.*
Witkowski et al., Conversion of b-ketoacyl synthase to a Malonyl Decarboxylase by replacement of the active cysteine with glutamine. Biochemistry, 1999, vol. 38: 11643-11650.*
Koshiba et al., "Partial Purification and some Properties of L- and D-Tryptophan Aminotransferases from Maize Coleoptiles," Enzymes Depend on Pyridoxal Phosphate and Other Carbonyl Compounds as Cofactors, International Union of Biochemistry Symposium 199, 8th International Symposium on Vitamin B6 and Carbonyl Catalysis, Oct. 15-19, 1990, Pergamon Press, pp. 245-247.
Lee et al., "Functional and structural characterization of D-amino acid aminotrasnferases from *Geobacillus* spp.," Appl. Environ. Microbiol., 2006, 72:1588-1594.
Li et al., "Biotechnological production of pyruvic acid," Appl. Microbiol. Biotechnol., 2001, 57:451-459.
Lo et al., "Asymmetric Synthesis of L-Homophenylalanine Using Engineered *Escherichia coli* Aspartate Aminotransferase" Biotechnol Prog., 2005, 21, 411-415.
Malashkevich et al., "Alternating arginine-modulated substrate specificity in an engineered tyrosine aminotransferase", Nature Structural Biology, 1995, vol. 2, No. 7: 548-553.
Onuffer et al., "Redesign of the substrate specificity of *Escherichia coli* aspartate aminotransferase to that of *Escherichia coli* tyrosine aminotransferase by homology modeling and side-directed mutagenesis," Protein Science, 1995, 4:1750-1757.
Rijnen et al., "Genetic Characterization of the Major Lactococcal Aromatic Aminotransferase and Its Involvement in Conversion of Amino Acids to Aroma Compounds," Applied Environmental Biology, 1999, 65(11):4873-4880.
Ro et al., "Site-directed mutagenesis of the amino acid residues in beta-strand III [Val30-Val36] of D-amino acid aminotransferase of *Bacillus* sp. YM-1," FEBS Lett., 1996, 398:141-145.

(Continued)

Primary Examiner — Ganapathirama Raghu

(57) ABSTRACT

The invention provides for aminotransferase and oxidoreductase polypeptides and nucleic acids encoding such polypeptides. Also provided are methods of using such aminotransferase and oxidoreductase nucleic acids and polypeptides.

16 Claims, 4 Drawing Sheets

(56) References Cited

OTHER PUBLICATIONS

Sugio et al, "Crystal structure of a D-amino acid aminotransferase: how the protein controls stereoselectivity," Biochemistry, 1995, 34:9661-9669.

Tanizawa et al., "Thermostable D-amino acid aminotransferase from a thermophilic *Bacillus* species. Purification, characterization, and active site sequence determination," J. Biol. Chem., 1989, 264:2445-2449.

Vernal et al., "Isolation and partial characterization of a broad specificity aminotransferase from *Leishmania mexicana* promastigotes," Molecular and Biochemical Parasitology, 1998, 96:83-92.

Watson et al., "Cloning and Nucleotide Sequencing of *Rhizobium meliloti* Aminotransferase Genes: an Aspartate aminotransferase Required for Symbiotic Nitrogen Fixation is Atypical," Journal of Bacteriology, 1993, 175 (7):1919-1928.

Winter and Dekker, "Specificity of Aspartate Aminotransferase from Leguminous Plants for 4-Substituted Glutamic Acids," Plant Physiol., 1989, 89:1122-1128.

Yonaha et al., "D-Amino Acid Aminotransferase of *Bacillus sphaericus*," The Journal of Biological Chemistry, 1975, 250(17):6983-6989.

"Yoshimura et al., "Unique stereospecificity of D-amino acid aminotransferase and branched-chain L-amino acid aminotransferase for C-4' hydrogen transfer of the coenzyme," J. Am. Chem. Soc., 1993, 115:3897-3900".

* cited by examiner

Figure 1

```
SEQ ID NO:894   MDALGYYNGKWGPLDEMTVPMNDRGGFEGDGVYDATIAANGVIFALDEHIDRFLNSAKLLEIEIGFTKEELKKTFFEM--
SEQ ID NO:1066  MENLGYYNGKFGLLEEMTVPMLDRVGYFCDGVYDATYSRNHKIFALEEHIDRFYNSAGLLGIKLPYSKEQVKEILKEM--
SEQ ID NO:1064  MKDLGYYNGEYDLIENMKIPMNDRVGYFGDGVYDATYSRNHNIFALDEHIDRFYNSAELLRIKLPYTKKFMRELLKDM--
SEQ ID NO:1068  MKQVGYYNGTIADLNELKVPATDRALYFGDGCYDATTFKNNVAFALEDHLDRFYNSCRLLEIDFPLNRDELKEKLYAVID

SEQ ID NO:894   HSKVDKGVYMVWWQAIRGTGRRSHVFPAG--P---S--NLWIMIKPNHVDDLYRKIKLILMEDTRFLHCNIKTLNLIPNVIA
SEQ ID NO:1066  VLKVDSGEQFVWWQIIRGTGMRNHAFPGDEVP--S--NLWIMLKPLNIKDMSQKLKLILLEDTRFLHCNIKTLNLLPSVIA
SEQ ID NO:1064  VKKVDSGEQFVWWQVIRGTGMRNHAFLSE--DKVA-NIWIVLKELKVKDMSKKLKLILLEDTRFLHCNIKTLNLLPSVIA
SEQ ID NO:1068  ANEVPTGI--LWWQTSRGSGLRNHIFPED--S--QPNLLIFTAEYGLVPFDTEYKLISREDTRFLHCNIKTLNLLPNVIA

SEQ ID NO:894   SQRALEACGHEAVFHRGETVTECAHSNVHILIKNGRFITHQADNLILLRGIARSHLLQAGIRLNLPFDERFLISELFDADE
SEQ ID NO:1066  SQKTEEACGQEAVFHRGDRVTECAHSNVSILKDGILKTAPTDNLILPGIARAHLIKMCKSFNIEVDETAFILKELMEADE
SEQ ID NO:1064  AQKTEEACGQEAVFHRGDRVTECAHSNVSILKDEILKTAPTDNLILPGIARAHLIKMGKKFELEVDTPFILKELINADE
SEQ ID NO:1068  SQKANESHCQEVVFHRGDRVTECAHSNILILKDGVLCSPPRDNLILPGITLKHLLQLAKENNIETSEAPFIMDDLRNADE

SEQ ID NO:894   ILVSSSGTLGLSANTIDGKNVGGKAPELLKKIQGEVIREEIEATGYTPEWSTV*
SEQ ID NO:1066  VIVTSSGQFCMATSEIDGIPVGGKAPELVKKLQDALLNEELEETKTE-------
SEQ ID NO:1064  VIVTSSGQFCMTACEIDGRPVGGKAPDIIKKLQTALLNELEEIN---------
SEQ ID NO:1068  VIVSSSACLGIRAVELDGQPVGGKDGKTLKILQDAYAKKYNAETVSR-------
```

AMINOTRANSFERASE AND OXIDOREDUCTASE NUCLEIC ACIDS AND POLYPEPTIDES AND METHODS OF USING

CROSS-REFERENCE TO RELATED APPLICATIONS

This application is a National Stage application under 35 U.S.C. §371 and claims benefit under 35 U.S.C. §119(a) of International Application No. PCT/US2008/014137 having an International Filing Date of Dec. 31, 2008, which claims the benefit of priority under 35 U.S.C. §119(e) of U.S. Application No. 61/018,814 having a filing date of Jan. 3, 2008.

CROSS REFERENCE TO RELATED APPLICATIONS

This application claims benefit of priority under 35 U.S.C. 119(e) to U.S. Application No. 61/018,814 filed Jan. 3, 2008, which is incorporated herein by reference in its entirety.

INCORPORATION BY REFERENCE

A Sequence Listing is being filed concurrently with the filing of this application under PCT AI §801(a). The accompanying Sequence Listing, identified as 07_0245WO01seq.txt, is herein incorporated by reference.

Appendix 1 is being filed concurrently with the filing of this application under PCT AI §801(a). The accompanying Appendix, identified as 07_0245WO01app.txt, is a table related to the Sequence Listing and is herein incorporated by reference.

TECHNICAL FIELD

This invention relates to nucleic acids and polypeptides, and more particularly to nucleic acids and polypeptides encoding aminotransferases and oxidoreductases as well as methods of using such aminotransferases and oxidoreductases.

BACKGROUND

An aminotransferase enzyme catalyzes a transamination reaction between an amino acid and an alpha-keto acid. Alpha-aminotransferases catalyze a reaction that removes the amino group from an amino acid, forming an alpha-keto acid, and transferring the amino group to a reactant α-keto acid, converting the keto acid into an amino acid. Therefore, an aminotransferase is useful in the production of amino acids.

An oxidoreductase enzyme such as a dehydrogenase catalyzes a reaction that oxidizes a substrate by transferring one or more protons and a pair of electrons to an acceptor (e.g., transfers electrons from a reductant to an oxidant). Therefore, an oxidoreductase is useful in catalyzing the oxidative deamination of amino acids to keto acids or the reductive amination of keto acids to amino acids.

SUMMARY

This disclosure provides for a number of different aminotransferase and oxidoreductase polypeptides and the nucleic acids encoding such aminotransferase and oxidoreductase polypeptides. This disclosure also provides for methods of using such aminotransferase and oxidoreductase nucleic acids and polypeptides.

In one aspect, the invention provides for methods of converting tryptophan to indole-3-pyruvate (or, alternatively, indole-3-pyruvate to tryptophan). Such methods include combining tryptophan (or indole-3-pyruvate) with a) one or more nucleic acid molecules chosen from the group consisting of SEQ ID NOs:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 716, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, and 975, wherein the one or more nucleic acid molecules encode polypeptides having aminotransferase (AT) or oxidoreductase activity; b) a variant of a), wherein the variant encodes a polypeptide having AT or oxidoreductase activity; c) a fragment of a) or b), wherein the fragment encodes a polypeptide having AT or oxidoreductase activity; d) one or more polypeptides chosen from the group consisting of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 220 G240N, 220 T241N, SEQ ID NO:220 having one or more of the mutations shown in Table 43 or Table 52, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 870 T242N, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 1069, 1070, 1071, 1072 and 1073, wherein the one or more polypeptides has AT or oxidoreductase activity; e) a variant of d), wherein the variant has AT or oxidoreductase activity; or f) a fragment of d) or e), wherein the fragment has AT or oxidoreductase activity.

In another aspect, the invention provides methods of converting MP to monatin (or, alternatively, monatin to MP). Such methods generally include combining MP (or monatin) with a) one or more nucleic acid molecules chosen from the group consisting of SEQ ID NOs:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 716, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, and 975, wherein the one or more nucleic acid molecules encode polypeptides having aminotransferase (AT) or oxidoreductase activity; b) a variant of a), wherein the variant encodes a polypeptide having AT or oxidoreductase activity; c) a fragment of a) or b), wherein the fragment encodes a polypeptide having AT or oxidoreductase activity; d) one or more polypeptides chosen from the group consisting of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 220 G240N, 220 T241N, SEQ ID NO:220 having one or more of the mutations shown in Table 43 or Table 52, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 870 T242N, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 1069, 1070, 1071, 1072 and 1073, wherein the one or more polypeptides has AT or oxidoreductase activity; e) a variant of d), wherein the variant has AT or oxidoreductase activity; or f) a fragment of d) or e), wherein the fragment has AT or oxidoreductase activity.

In one embodiment, the one or more nucleic acid molecules are chosen from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 969, 971, 973, and 975. In another embodiment, the one or more polypeptides are chosen from the group consisting of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 220 G240N, 220 T241N, SEQ ID NO:220 having one or more of the mutations shown in Table 43 or Table 52, 222, 224, 226, 228, 230, 232, 234, 236, 238, 240, 242, 244, 246, 248, 250, 866, 868, 870, 870 T242N, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 970, 972, 974, and 976.

In certain embodiments, the nucleic acid molecule has a sequence selected from the group consisting of SEQ ID NOs: 945, 891, 893, 219, 175, 1063, 1065, and 1067. In certain embodiments, the polypeptide has a sequence selected from the group consisting of SEQ ID NOs:946, 892, 894, 220, 176, 1064, 1066, and 1068. In certain embodiments, the polypeptide has a sequence that corresponds to the consensus sequence shown in SEQ ID NO:1069 or 1070. In certain embodiments, the polypeptide has a sequence that corresponds to the consensus sequence shown in SEQ ID NO:1071, 1072, and 1073.

In some embodiments, the variant is a nucleic acid molecule that has at least 80% (e.g., at least 85%, at least 90%, at least 95%, or at least 99%) sequence identity to SEQ ID NOs:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 969, 971, 973, and 975.

In some embodiments, the variant is a polypeptide that has at least 80% (e.g., at least 85%, at least 90%, at least 95%, or at least 99%) sequence identity to SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 220 G240N, 220 T241N, SEQ ID NO:220 having one or more of the mutations shown in Table 43 or Table 52, 222, 224, 226, 228, 230, 232, 234, 236, 238, 240, 242, 244, 246, 248, 250, 866, 868, 870, 870 T242N, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 970, 972, 974, and 976.

In one embodiment, the variant is a polypeptide that has at least 65% (e.g., at least 70%, at least 75%, at least 80%, at least 85%, at least 90%, at least 95%, or at least 99%) sequence identity to SEQ ID NO:220. In another embodiment, the variant is a polypeptide that has at least 80% (e.g., at least 85%, at least 90%, at least 95%, or at least 99%) sequence identity to SEQ ID NO:870. In yet another embodiment, the variant is a polypeptide that has at least 65% (e.g., at least 70%, at least 75%, at least 80%, at least 85%, at least 90%, at least 95%, or at least 99%) sequence identity to SEQ ID NO:894.

In certain embodiments, the variant is a mutant. Representative mutants include, without limitation, a mutant having a mutation at the residue that aligns with residue 243 of DAT 4978 (e.g., SEQ ID NO:870 T242N, SEQ ID NO:220 G240N, or SEQ ID NO:220 T241N). In one embodiment, the variant is a nucleic acid molecule that has been codon optimized. In certain embodiments, the variant polypeptide is a chimeric polypeptide.

In certain embodiments, a nucleic acid molecule is contained within an expression vector and can be, for example, overexpressed. In certain embodiments, the aminotransferase or oxidoreductase polypeptide is immobilized on a solid support. In certain embodiments, the tryptophan or the MP is a substituted tryptophan or a substituted MP. A representative tryptophan is 6-chloro-D-tryptophan.

In another aspect, the invention provides methods of converting tryptophan to indole-3-pyruvate (or, alternatively, indole-3-pyruvate to tryptophan). Such methods typically include combining tryptophan (or indole-3-pyruvate) with a) one or more nucleic acid molecules chosen from the group consisting of SEQ ID NOs:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 969, 971, 973, and 975, wherein the one or more nucleic acid molecules encode polypeptides having D-aminotransferase (DAT) activity; b) a variant of a), wherein the variant encodes a polypeptide having DAT activity; c) a fragment of a) or b), wherein the fragment encodes a polypeptide having DAT activity; d) one or more polypeptides chosen from the group consisting of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 220 G240N, 220 T241N, SEQ ID NO:220 having one or more of the mutations shown in Table 43 or Table 52, 222, 224, 226, 228, 230, 232, 234, 236, 238, 240, 242, 244, 246, 248, 250, 866, 868, 870, 870 T242N, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 970, 972, 974, 976, 1069, 1070, 1071, 1072 and 1073, wherein the one or more polypeptides has DAT activity; e) a variant of d), wherein the variant has DAT activity; or f) a fragment of d) or e), wherein the fragment has DAT activity.

In still another aspect, the invention provides for methods of converting MP to monatin (or, alternatively, monatin to MP). Such methods generally include combining MP (or monatin) with a) one or more nucleic acid molecules chosen from the group consisting of SEQ ID NOs:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 969, 971, 973, and 975, wherein the one or more nucleic acid molecules encode polypeptides having DAT activity; b) a variant of a), wherein the variant encodes a polypeptide having DAT activity; c) a fragment of a) or b), wherein the fragment encodes a polypeptide having DAT activity; d) one or more polypeptides chosen from the group consisting of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 220 G240N, 220 T241N, SEQ ID NO:220 having one or more of the mutations shown in Table 43 or Table 52, 222, 224, 226, 228, 230, 232, 234, 236, 238, 240, 242, 244, 246, 248, 250, 866, 868, 870, 870 T242N, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 970, 972, 974, 976, 1069, 1070, 1071, 1072 and 1073, wherein the one or more polypeptides has DAT activity; e) a variant of d), wherein the variant has DAT activity; or f) a fragment of d) or e), wherein the fragment has DAT activity.

In certain embodiments, the nucleic acid molecule or polypeptide has a sequence selected from the group consisting of SEQ ID NO:945, 891, 893, 219, 175, 1063, 1065, and 1067. In certain embodiments, the polypeptide has a sequence that corresponds to a consensus sequence shown in SEQ ID NO:1069, 1070, 1071, 1072 or 1073. In some embodiments, the tryptophan or the MP is a substituted tryptophan or a substituted MP. A representative substituted tryptophan is 6-chloro-D-tryptophan.

In still another aspect, the invention provides methods of making monatin. Generally, such methods include contacting tryptophan, under conditions in which monatin is produced, with a C3 carbon source and a) one or more nucleic acid molecules chosen from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 969, 971, 973, and 975, wherein the one or more nucleic acid molecules encode polypeptides having D-aminotransferase (DAT) activity; b) a variant of a), wherein the variant encodes a polypeptide having DAT activity; c) a fragment of a) or b), wherein the fragment encodes a polypeptide having DAT activity; d) one or more polypeptides chosen from the group consisting of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 220 G240N, 220 T241N, SEQ ID NO:220 having one or more of the mutations shown in Table 43 or Table 52, 222, 224, 226, 228, 230, 232, 234, 236, 238, 240, 242, 244, 246, 248, 250, 866, 868, 870, 870 T242N, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 970, 972, 974, 976, 1069, 1070, 1071, 1072 and 1073, wherein the one or more polypeptides has DAT activity; e) a variant of d), wherein the variant has DAT activity; or f) a fragment of d) or e), wherein the fragment has DAT activity.

In some embodiments, the nucleic acid molecule is chosen from the group consisting of SEQ ID NO: 945, 891, 893, 219, 175, 1063, 1065, and 1067. In some embodiments, the C3 carbon source is selected from the group consisting of pyruvate, oxaloacetate, and serine. In some embodiments, the method further comprises adding or including a synthase/lyase (EC 4.1.2.- or 4.1.3.-) polypeptide. Representative synthase/lyase (EC 4.1.2.- or 4.1.3.-) polypeptides include aldolases such as KHG aldolases (EC 4.1.3.16) or HMG aldolases (EC 4.1.3.16).

In some embodiments of the above-indicated methods, the monatin produced is R,R monatin. In some embodiments, the monatin produced is S,R monatin. In certain embodiments, the tryptophan is a substituted tryptophan such as, for example, 6-chloro-D-tryptophan.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In addition, the materials, methods, and examples are illustrative only and not intended to be limiting. All publications, patent applications, patents, and other references mentioned herein are incorporated by reference in their entirety. In case of conflict, the present specification, including definitions, will control.

The details of one or more embodiments of the invention are set forth in the accompanying drawings and the description below. Other features, objects, and advantages of the invention will be apparent from the drawings and detailed description, and from the claims.

DESCRIPTION OF DRAWINGS

FIG. 1 is an alignment of SEQ ID NO:894, 1066, 1064, and 1068.

FIG. 2 is an alignment of SEQ ID NO:870, 910, and several *Bacillus* sequences. Consensus sequences A and B (SEQ ID NO:1069 and 1070, respectively) directed toward the novel portions of SEQ ID NO:870 were developed from this alignment.

FIG. 3 is an alignment of SEQ ID NO:946, 894, 892, 220, 176, 1064, 1066, and 1068. Consensus sequences C, D and E (SEQ ID NO:1071, 1072 and 1073, respectively) were developed from this alignment.

Like reference symbols in the various drawings indicate like elements.

DETAILED DESCRIPTION

Figure 4:
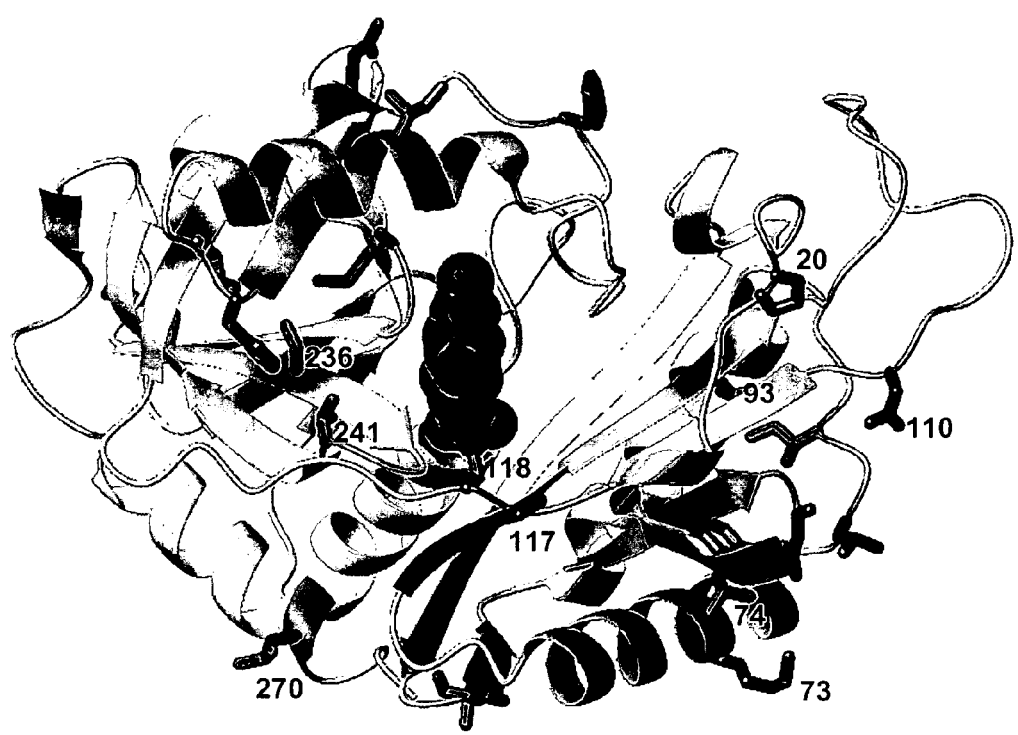
FIG. 4 is a model of 3DAA-D-amino acid aminotransferase, with numbered residues indicating those sites selected for TMCA$^{SM}$ evolution, as described in detail below.

Disclosed herein are a number of different nucleic acid molecules encoding polypeptides having aminotransferase (AT) activity (e.g., transaminase activity). Specifically disclosed are a number of D-aminotransferases (DATs). DATs catalyze a transamination reaction (e.g., D-alanine+2-oxoglutarate<=>pyruvate+D-glutamate). Also provided are a number of different nucleic acid molecules encoding polypeptides having oxidoreductase activity (e.g., dehydrogenase activity). Oxidoreductases such as dehydrogenases catalyze an oxidation-reduction reaction (e.g., D-amino acid+$H_2O$+acceptor<=>a 2-oxo acid+$NH_3$+reduced acceptor). The nucleic acids or polypeptides disclosed herein can be used to convert tryptophan to indole-3-pyruvate and/or 2-hydroxy 2-(indol-3-ylmethyl)-4-keto glutaric acid ("monatin precursor" or "MP") to monatin.

Isolated Nucleic Acid Molecules and Purified Polypeptides

The present invention is based, in part, on the identification of nucleic acid molecules encoding polypeptides having aminotransferase (AT) activity, herein referred to as "AT" nucleic acid molecules or polypeptides, where appropriate. The present invention also is based, in part, on the identification of nucleic acid molecules encoding polypeptides having oxidoreductase activity, herein referred to as "oxidoreductase" nucleic acid molecules or polypeptides, where appropriate.

Particular nucleic acid molecules described herein include the sequences shown in SEQ ID NOs:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 716, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, and 975. As used herein, the term "nucleic acid molecule" can include DNA molecules and RNA molecules, analogs of DNA or RNA generated using nucleotide analogs. A nucleic acid molecule of the invention can be single-stranded or double-stranded, depending upon its intended use. Nucleic acid molecules of the invention include molecules that have at least 75% sequence identity (e.g., at least 80%, 85%, 90%, 95%, or 99% sequence identity) to any of SEQ ID NOs:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 716, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, and 975 and that have functional AT or oxidoreductase activity.

In calculating percent sequence identity, two sequences are aligned and the number of identical matches of nucleotides or amino acid residues between the two sequences is determined. The number of identical matches is divided by the length of the aligned region (i.e., the number of aligned nucleotides or amino acid residues) and multiplied by 100 to arrive at a percent sequence identity value. It will be appreciated that the length of the aligned region can be a portion of one or both sequences up to the full-length size of the shortest sequence. It will be appreciated that a single sequence can align differently with other sequences and hence, can have different percent sequence identity values over each aligned region. It is noted that the percent identity value is usually rounded to the nearest integer. For example, 78.1%, 78.2%, 78.3%, and 78.4% are rounded down to 78%, while 78.5%, 78.6%, 78.7%, 78.8%, and 78.9% are rounded up to 79%. It is also noted that the length of the aligned region is always an integer.

The alignment of two or more sequences to determine percent sequence identity is performed using the algorithm described by Altschul et al. (1997, *Nucleic Acids Res.,* 25:3389-3402) as incorporated into BLAST (basic local alignment search tool) programs, available at ncbi.nlm.nih.gov on the World Wide Web. BLAST searches can be performed to determine percent sequence identity between an AT nucleic acid molecule described herein and any other sequence or portion thereof aligned using the Altschul et al. algorithm. BLASTN is the program used to align and compare the identity between nucleic acid sequences, while BLASTP is the program used to align and compare the identity between amino acid sequences. When utilizing BLAST programs to calculate the percent identity between a sequence of the invention and another sequence, the default parameters of the respective programs are used.

Nucleic acid molecules of the invention, for example, those between about 10 and about 50 nucleotides in length, can be used, under standard amplification conditions, to amplify an AT or oxidoreductase nucleic acid molecule. Amplification of an AT or oxidoreductase nucleic acid can be for the purpose of detecting the presence or absence of an AT or oxidoreductase nucleic acid molecule or for the purpose of obtaining (e.g., cloning) an AT or oxidoreductase nucleic acid molecule. As used herein, standard amplification conditions refer to the basic components of an amplification reaction mix, and cycling conditions that include multiple cycles of denaturing the template nucleic acid, annealing the oligonucleotide primers to the template nucleic acid, and extension of the primers by the polymerase to produce an amplification product (see, for example, U.S. Pat. Nos. 4,683,195; 4,683,202; 4,800,159; and 4,965,188). The basic components of an amplification reaction mix generally include, for example, each of the four deoxynucleoside triphosphates, (e.g., dATP, dCTP, dTTP, and dGTP, or analogs thereof), oligonucleotide primers, template nucleic acid, and a polymerase enzyme. Template nucleic acid is typically denatured at a temperature of at least about 90° C., and extension from primers is typically performed at a temperature of at least about 72° C. In addition, variations to the original PCR methods (e.g., anchor PCR, RACE PCR, or ligation chain reaction (LCR)) have been developed and are known in the art. See, for example, Landegran et al., 1988, *Science,* 241:1077-1080; and Nakazawa et al., 1994, *Proc. Natl. Acad. Sci. USA,* 91:360-364).

The annealing temperature can be used to control the specificity of amplification. The temperature at which primers anneal to template nucleic acid must be below the Tm of each of the primers, but high enough to avoid non-specific annealing of primers to the template nucleic acid. The Tm is the temperature at which half of the DNA duplexes have separated into single strands, and can be predicted for an oligonucleotide primer using the formula provided in section 11.46 of Sambrook et al. (1989, *Molecular Cloning: A Laboratory Manual,* 2nd Ed., Cold Spring Harbor Laboratory Press, Cold Spring Harbor, N.Y.). Non-specific amplification products are detected as bands on a gel that are not the size expected for the correct amplification product.

Nucleic acid molecules of the invention, for example, those between about 10 and several hundred nucleotides in length (up to several thousand nucleotides in length), can be used, under standard hybridization conditions, to hybridize to an AT or oxidoreductase nucleic acid molecule. Hybridization to an AT or oxidoreductase nucleic acid molecule can be for the purpose of detecting or obtaining an AT or oxidoreductase nucleic acid molecule. As used herein, standard hybridization conditions between nucleic acid molecules are discussed in detail in Sambrook et al. (1989, *Molecular Cloning: A Laboratory Manual,* $2^{nd}$ Ed., Cold Spring Harbor Laboratory Press, Cold Spring Harbor, N.Y.; Sections 7.37-7.57, 9.47-9.57, 11.7-11.8, and 11.45-11.57). For oligonucleotide probes less than about 100 nucleotides, Sambrook et al. discloses suitable Southern blot conditions in Sections 11.45-11.46. The Tm between a sequence that is less than 100 nucleotides in length and a second sequence can be calculated using the formula provided in Section 11.46. Sambrook et al. additionally discloses prehybridization and hybridization conditions for a Southern blot that uses oligonucleotide probes greater than about 100 nucleotides (see Sections 9.47-9.52). Hybridizations with an oligonucleotide greater than 100 nucleotides generally are performed 15-25° C. below the Tm. The Tm between a sequence greater than 100 nucleotides in length and a second sequence can be calculated using the formula provided in Sections 9.50-9.51 of Sambrook et al. Additionally, Sambrook et al. recommends the conditions indicated in Section 9.54 for washing a Southern blot that has been probed with an oligonucleotide greater than about 100 nucleotides.

The conditions under which membranes containing nucleic acids are prehybridized and hybridized, as well as the conditions under which membranes containing nucleic acids are washed to remove excess and non-specifically bound probe can play a significant role in the stringency of the hybridization. For example, hybridization and washing may be carried out under conditions of low stringency, moderate stringency or high stringency. Such conditions are described, for example, in Sambrook et al. section 11.45-11.46. The conditions used to achieve a particular level of stringency will vary, depending on the nature of the nucleic acids being hybridized. For example, the length, degree of complementarity, nucleotide sequence composition (e.g., G/C vs. A/T nucleotide content) and nucleic acid type (e.g., RNA v. DNA) of the hybridizing regions of the nucleic acids can be considered in selecting hybridization conditions. For example, washing conditions can be made more stringent by decreasing the salt concentration in the wash solutions and/or by increasing the temperature at which the washes are performed.

The amount of hybridization can be quantitated directly on a membrane or from an autoradiograph using, for example, a PhosphorImager or a Densitometer (Molecular Dynamics, Sunnyvale, Calif.). It is understood by those of skill in the art that interpreting the amount of hybridization can be affected by, for example, the specific activity of the labeled oligonucleotide probe, the number of probe-binding sites on the target nucleic acid, and the amount of exposure of an autoradiograph or other detection medium. It will be readily appreciated that, although any number of hybridization, washing and detection conditions can be used to examine hybridization of a probe nucleic acid molecule to immobilized target nucleic acids, it is more important to examine hybridization of a probe to target nucleic acids under identical hybridization, washing, and detection conditions. Preferably, the target nucleic acids are on the same membrane. It can be appreciated by those of skill in the art that appropriate positive and negative controls should be performed with every set of amplification or hybridization reactions to avoid uncertainties related to contamination and/or non-specific annealing of oligonucleotide primers or probes.

Oligonucleotide primers or probes specifically anneal or hybridize to one or more AT or oxidoreductase nucleic acids. For amplification, a pair of oligonucleotide primers generally anneal to opposite strands of the template nucleic acid, and should be an appropriate distance from one another such that the polymerase can effectively polymerize across the region and such that the amplification product can be readily detected using, for example, electrophoresis. Oligonucleotide primers or probes can be designed using, for example, a computer program such as OLIGO (Molecular Biology Insights Inc., Cascade, Colo.) to assist in designing oligonucleotides. Typically, oligonucleotide primers are 10 to 30 or 40 or 50 nucleotides in length (e.g., 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length), but can be longer or shorter if appropriate amplification conditions are used.

Non-limiting representative pairs of oligonucleotide primers that were used to amplify D-aminotransferase (DAT) nucleic acid molecules are shown in Tables 2-8 (SEQ ID NOs:978-1062 and 1074-1083), Table 46 (SEQ ID NOs: 1084-1103) and Table 54 (SEQ ID NOs:1104-1125). The sequences shown in SEQ ID NOs:978-1062 and 1074-1083 are non-limiting examples of oligonucleotide primers that can be used to amplify AT nucleic acid molecules. Oligonucleotides in accordance with the invention can be obtained by restriction enzyme digestion of an AT or oxidoreductase nucleic acid molecules or can be prepared by standard chemical synthesis and other known techniques.

As used herein, an "isolated" nucleic acid molecule is a nucleic acid molecule that is separated from other nucleic acid molecules that are usually associated with the isolated nucleic acid molecule. Thus, an "isolated" nucleic acid molecule includes, without limitation, a nucleic acid molecule that is free of sequences that naturally flank one or both ends of the nucleic acid in the genome of the organism from which the isolated nucleic acid is derived (e.g., a cDNA or genomic DNA fragment produced by PCR or restriction endonuclease digestion). Such an isolated nucleic acid molecule is generally introduced into a vector (e.g., a cloning vector, or an expression vector) for convenience of manipulation or to generate a fusion nucleic acid molecule. In addition, an isolated nucleic acid molecule can include an engineered nucleic acid molecule such as a recombinant or a synthetic nucleic acid molecule. A nucleic acid molecule existing among hundreds to millions of other nucleic acid molecules within, for example, a nucleic acid library (e.g., a cDNA, or genomic library) or a portion of a gel (e.g., agarose, or polyacrylamine) containing restriction-digested genomic DNA is not to be considered an isolated nucleic acid.

Isolated nucleic acid molecules described herein having AT or oxidoreductase activity can be obtained using techniques routine in the art, many of which are described in the Examples herein. For example, isolated nucleic acids within the scope of the invention can be obtained using any method including, without limitation, recombinant nucleic acid technology, the polymerase chain reaction (e.g., PCR, e.g., direct amplification or site-directed mutagenesis), and/or nucleic acid hybridization techniques (e.g., Southern blotting). General PCR techniques are described, for example in *PCR Primer: A Laboratory Manual*, Dieffenbach & Dveksler, Eds., Cold Spring Harbor Laboratory Press, 1995. Recombinant nucleic acid techniques include, for example, restriction enzyme digestion and ligation, which can be used to isolate an AT or oxidoreductase nucleic acid molecule as described herein. Isolated nucleic acids of the invention also can be chemically synthesized, either as a single nucleic acid molecule or as a series of oligonucleotides.

Techniques for the manipulation of nucleic acids, such as, e.g., subcloning, labeling probes (e.g., random-primer labeling using Klenow polymerase, nick translation, amplification), sequencing, hybridization, amplification and the like are well described in the scientific and patent literature, see, e.g., Sambrook et al., Eds., 1989, *Molecular Cloning: A Laboratory Manual* ($2^{nd}$ Ed.), Vols 1-3, Cold Spring Harbor Laboratory; *Current Protocols in Molecular Biology*, 1997, Ausubel, Ed. John Wiley & Sons, Inc., New York; *Laboratory Techniques in Biochemistry and Molecular Biology: Hybridization with Nucleic Acid Probes, Part I. Theory and Nucleic Acid Preparation*, Tijssen, Ed. Elsevier, N.Y. (1993).

Purified AT or oxidoreductase polypeptides, as well as polypeptide fragments having AT or oxidoreductase activity, are within the scope of the invention. AT polypeptides refer to polypeptides that catalyze a reaction between an amino group and a keto acid. Specifically, a transamination reaction by a DAT involves removing an amino group from an amino acid leaving behind an alpha-keto acid, and transferring the amino group to the reactant alpha-keto acid, thereby converting the alpha-keto acid into an amino acid. The predicted amino acid sequences of AT polypeptides are shown in SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, SEQ ID NO:220 having one or more of the mutations shown in Table 43 or Table 52, 222, 224, 226, 228, 230, 232, 234, 236, 238, 240, 242, 244, 246, 248, 250, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 970, 972, 974, and 976. An oxidoreductase polypeptide refers to a polypeptide that catalyzes an oxidation-reduction reaction, and the predicted amino acid sequences of oxidoreductase polypeptides are shown in SEQ ID NOs:252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 962, 964, 966 and 968.

The term "purified" polypeptide as used herein refers to a polypeptide that has been separated from cellular components that naturally accompany it. Typically, a polypeptide is considered "purified" when it is at least partially free from the proteins and naturally occurring molecules with which it is naturally associated. The extent of enrichment or purity of an AT or oxidoreductase polypeptide can be measured using any appropriate method, e.g., column chromatography, polyacrylamide gel electrophoresis, or HPLC analysis.

The invention also provides for AT and oxidoreductase polypeptides that differ in sequence from SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, SEQ ID NO:220 having one or more of the mutations shown in Table 43 or Table 52, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, and 976) or in an AT or oxidoreductase nucleic acid molecule (e.g., SEQ ID NOs:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 716, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, and 975), thereby leading to changes in the amino acid sequence of the encoded polypeptide. AT and oxidoreductase polypeptides that differ in sequence from SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, SEQ ID NO:220 having one or more of the mutations shown in Table 43 or Table 52, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, and 976 and that retain aminotransferase and oxidoreductase activity, respectively, readily can be identified by screening methods routinely used in the art.

For example, changes can be introduced into an AT or oxidoreductase nucleic acid coding sequence that lead to conservative and/or non-conservative amino acid substitutions at one or more amino acid residues in the encoded AT or oxidoreductase polypeptide. Changes in nucleic acid sequences can be generated by standard techniques, such as site-directed mutagenesis, PCR-mediated mutagenesis of a nucleic acid encoding such a polypeptide, or directed evolution. In addition, changes in the polypeptide sequence can be introduced randomly along all or part of the AT or oxidoreductase polypeptide, such as by saturation mutagenesis of the corresponding nucleic acid. Alternatively, changes can be introduced into a nucleic acid or polypeptide sequence by chemically synthesizing a nucleic acid molecule or polypeptide having such changes.

A "conservative amino acid substitution" is one in which one amino acid residue is replaced with a different amino acid residue having a similar side chain. Similarity between amino acid residues has been assessed in the art. For example, Dayhoff et al. (1978, in *Atlas of Protein Sequence and Structure*, 5(Suppl. 3):345-352) provides frequency tables for amino acid substitutions that can be employed as a measure of amino acid similarity. Examples of conservative substitutions include, for example, replacement of an aliphatic amino acid with another aliphatic amino acid; replacement of a serine with a threonine or vice versa; replacement of an acidic residue with another acidic residue; replacement of a residue bearing an amide group with another residue bearing an amide group; exchange of a basic residue with another basic residue; or replacement of an aromatic residue with another aromatic residue. A non-conservative substitution is one in which an amino acid residue is replaced with an amino acid residue that does not have a similar side chain.

Changes in a nucleic acid can be introduced using one or more mutagens. Mutagens include, without limitation, ultraviolet light, gamma irradiation, or chemical mutagens (e.g., mitomycin, nitrous acid, photoactivated psoralens, sodium bisulfite, nitrous acid, hydroxylamine, hydrazine or formic acid). Other mutagens are analogues of nucleotide precursors, e.g., nitrosoguanidine, 5-bromouracil, 2-aminopurine, or acridine. Intercalating agents such as proflavine, acriflavine, quinacrine and the like can also be used.

Changes also can be introduced into an AT or oxidoreductase nucleic acid and/or polypeptide by methods such as error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, gene reassembly (e.g., GeneReassembly, see, e.g., U.S. Pat. No. 6,537, 776), Gene Site Saturation Mutagenesis (GSSM), synthetic ligation reassembly (SLR), or a combination thereof. Changes also can be introduced into polypeptides by methods such as recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, or any combination thereof.

An AT or oxidoreductase nucleic acid can be codon optimized if so desired. For example, a non-preferred or a less preferred codon can be identified and replaced with a preferred or neutrally used codon encoding the same amino acid as the replaced codon. A preferred codon is a codon overrepresented in coding sequences in genes in the host cell and a non-preferred or less preferred codon is a codon underrepresented in coding sequences in genes in the host cell, thereby modifying the nucleic acid to increase its expression in a host cell. An AT or oxidoreductase nucleic acid can be optimized for particular codon usage from any host cell (e.g., any of the host cells described herein). See, for example, U.S. Pat. No. 5,795,737 for a representative description of codon optimization. In addition to codon optimization, a nucleic acid can undergo directed evolution. See, for example, U.S. Pat. No. 6,361,974.

Other changes also are within the scope of this disclosure. For example, one, two, three, four or more amino acids can be removed from the carboxy- and/or amino-terminal ends of an aminotransferase or oxidoreductase polypeptide without significantly altering the biological activity. In addition, one or more amino acids can be changed to increase or decrease the pI of a polypeptide. In some embodiments, a residue can be changed to, for example, a glutamate. Also provided are chimeric aminotransferase or oxidoreductase polypeptides. For example, a chimeric AT or oxidoreductase polypeptide can include portions of different binding or catalytic domains. Methods of recombining different domains from different polypeptides and screening the resultant chimerics to find the best combination for a particular application or substrate are routine in the art.

One particular change in sequence that was exemplified herein involves the residue corresponding to residue 243 in a DAT from ATCC Accession No. 4978 (DAT 4978). In one instance, the polypeptide sequence of the SEQ ID NO:870 DAT was aligned with DAT 4978 and the residue in SEQ ID NO:870 that aligns with position 243 in DAT 4978 was identified (residue 242) and changed from Thr to Asn (SEQ ID NO:870 T242N). In another instance, the polypeptide sequence of the SEQ ID NO:220 DAT was aligned with DAT 4978 and the residue in SEQ ID NO:220 that aligns with position 243 in DAT 4978 was identified (either residue 240 or 241) and changed from Gly to Asn or Thr to Asn, respectively (SEQ ID NO:220 G240N and SEQ ID NO:220 T241N). Those of skill in the art can readily identify the residue that corresponds to residue 243 from DAT 4978 in any of the DATs disclosed herein and introduce a change into the polypeptide sequence at that particular residue. A number of additional DAT mutants were made and are listed in Tables 43 and 52.

It is noted that SEQ ID NO:894 is a novel DAT, for which the closest sequence in the public databases exhibits only 60% sequence identity to the SEQ ID NO:894 polypeptide. Therefore, polypeptides of the invention include sequences that have at least, for example, 65% sequence identity (e.g., at least 70%, 75%, 80%, 85%, 90%, 95%, or 99% sequence identity) to SEQ ID NO:894 and that have functional DAT activity. In addition, SEQ ID NO:870 also is a novel DAT and has 76% sequence identity to a Bacillus DAT polypeptide and 69% sequence identity to a B. sphaericus DAT polypeptide. Therefore, polypeptides of the invention include sequences having at least 80% sequence identity (e.g., at least 85%, 90%, 95%, or 99% sequence identity) to SEQ ID NO:870 and that have DAT activity. Further, SEQ ID NO:220 is a novel DAT that has 62% sequence identity to a DAT polypeptide from C. beijerinckii. Therefore, polypeptides of the invention include sequences having at least 65% sequence identity (e.g., at least 70%, 75%, 80%, 85%, 90%, 95%, or 99% sequence identity) to SEQ ID NO:220.

In one instance, SEQ ID NO:870 and 910 were aligned with published DATs and a consensus sequence was determined. The consensus sequence for SEQ ID NO:870-like DAT polypeptides that make it unique from the rest of the group of Bacillus-like DAT polypeptides is shown in SEQ ID NO:1069 (consensus sequence A). In another instance, SEQ ID NO:176, 220, 892, 894 and 946 were aligned and a consensus sequence was determined. The consensus sequence for this group of DATs is shown in SEQ ID NO:1071 (consensus sequence C). SEQ ID NO:1070 (consensus sequence B) represents a slightly more conservative consensus sequence relative to SEQ ID NO:1069 (consensus sequence A), while SEQ ID NO:1072 (consensus sequence D) and SEQ ID NO:1073 (consensus sequence E) correspond to slightly more conservative consensus sequences relative to SEQ ID NO:1071 (consensus sequence C). It is expected that polypeptides having a consensus sequence that corresponds to consensus sequence A, B, C, D or E as disclosed herein would exhibit DAT activity.

A fragment of an aminotransferase and oxidoreductase nucleic acid or polypeptide refers to a portion of a full-length aminotransferase and oxidoreductase nucleic acid or polypeptide. As used herein, "functional fragments" are those fragments of an aminotransferase or oxidoreductase polypeptide that retain the respective enzymatic activity. "Functional fragments" also refer to fragments of an aminotransferase or oxidoreductase nucleic acid that encode a polypeptide that retains the respective anzymatic activity. For example, functional fragments can be used in in vitro or in vivo reactions to catalyze transaminase or oxidation-reduction reactions, respectively.

AT or oxidoreductase polypeptides can be obtained (e.g., purified) from natural sources (e.g., a biological sample) by known methods such as DEAE ion exchange, gel filtration, and hydroxyapatite chromatography. Natural sources include, but are not limited to, microorganisms such as bacteria and yeast. A purified AT or oxidoreductase polypeptide also can be obtained, for example, by cloning and expressing an AT or oxidoreductase nucleic acid (e.g., SEQ ID NOs:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 716, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, and 975) and purifying the resultant polypeptide using, for example, any of the known expression systems including, but not limited to, glutathione S-transferase (GST), pGEX (Pharmacia Biotech Inc), pMAL (New England Biolabs, Beverly, Mass.) or pRIT5 (Pharmacia, Piscataway, N.J.)). In addition, a purified AT or oxidoreductase polypeptide can be obtained by chemical synthesis using, for example, solid-phase synthesis techniques (see e.g., Roberge, 1995, *Science,* 269:202; Merrifield, 1997, *Methods Enzymol.,* 289:3-13).

A purified AT or oxidoreductase polypeptide or a fragment thereof can be used as an immunogen to generate polyclonal or monoclonal antibodies that have specific binding affinity for one or more AT or oxidoreductase polypeptides. Such antibodies can be generated using standard techniques that are used routinely in the art. Full-length AT or oxidoreductase polypeptides or, alternatively, antigenic fragments of AT or oxidoreductase polypeptides can be used as immunogens. An antigenic fragment of an AT or oxidoreductase polypeptide usually includes at least 8 (e.g., 10, 15, 20, or 30) amino acid residues of an AT or oxidoreductase polypeptide (e.g., having the sequence shown in SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, SEQ ID NO:220 having one or more of the mutations shown in Table 43 or Table 52, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, and 976), and encompasses an epitope of an AT or oxidoreductase polypeptide such that an antibody (e.g., polyclonal or monoclonal; chimeric or humanized) raised against the antigenic fragment has specific binding affinity for one or more AT or oxidoreductase polypeptides.

Polypeptides can be detected and quantified by any method known in the art including, but not limited to, nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immuno-fluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, one or more, or, all the polypeptides of a cell can be measured using a protein array.

Methods of Using DAT or Oxidoreductase Nucleic Acids and Polypeptides

The AT or oxidoreductase polypeptides or the AT or oxidoreductase nucleic acids encoding such AT and oxidoreductase polypeptides, respectively, can be used to facilitate the conversion of tryptophan to indole-3-pyruvate and/or to facilitate the conversion of MP to monatin (or the reverse reaction). It is noted that the reactions described herein are not limited to any particular method, unless otherwise stated. The reactions disclosed herein can take place, for example, in vivo, in vitro, or a combination thereof.

Constructs containing AT or oxidoreductase nucleic acid molecules are provided. Constructs, including expression vectors, suitable for expressing an AT or oxidoreductase polypeptide are commercially available and/or readily produced by recombinant DNA technology methods routine in the art. Representative constructs or vectors include, without limitation, replicons (e.g., RNA replicons, bacteriophages), autonomous self-replicating circular or linear DNA or RNA, a viral vector (e.g., an adenovirus vector, a retroviral vector or an adeno-associated viral vector), a plasmid, a phage, a phagemid, a cosmid, a fosmid, a bacteriophage or an artificial chromosome. The cloning vehicle can comprise an artificial chromosome comprising a bacterial artificial chromosome (BAC), a bacteriophage P1-derived vector (PAC), a yeast artificial chromosome (YAC), or a mammalian artificial chromosome (MAC). Exemplary vectors include, without limitation, pBR322 (ATCC 37017), pKK223-3, pSVK3, pBPV, pMSG, and pSVL (Pharmacia Fine Chemicals, Uppsala, Sweden), GEM1 (Promega Biotec, Madison, Wis., USA) pQE70, pQE60, pQE-9 (Qiagen), pD10, psiX174 pBluescript II KS, pNH8A, pNH16a, pNH18A, pNH46A, pSV2CAT, pOG44, pXT1, pSG (Stratagene), ptrc99a, pKK223-3, pKK233-3, DR540, pRIT5 (Pharmacia), pKK232-8 and pCM7. See, also, U.S. Pat. No. 5,217,879 for a description of representative plasmids, viruses, and the like.

A vector or construct containing an AT or oxidoreductase nucleic acid molecule can have elements necessary for expression operably linked to the AT or oxidoreductase nucleic acid. Elements necessary for expression include nucleic acid sequences that direct and regulate expression of nucleic acid coding sequences. One example of an element necessary for expression is a promoter sequence. Promoter sequences are sequences that are capable of driving transcription of a coding sequence. A promoter sequence can be, for example, an AT or oxidoreductase promoter sequence, or a non-AT or non-oxidoreductase promoter sequence. Non-AT and non-oxidoreductase promoters include, for example, bacterial promoters such as lacZ, T3, T7, gpt, lambda PR, lambdaPL and trp as well as eukaryotic promoters such as CMV immediate early, HSV thymidine kinase, early and late SV40, LTRs from retrovirus, and mouse metallothionein I. Promoters also can be, for example, constitutive, inducible, and/or tissue-specific. A representative constitutive promoter is the CaMV 35S; representative inducible promoters include, for example, arabinose, tetracycline-inducible and salicylic acid-responsive promoters.

Additional elements necessary for expression can include introns, enhancer sequences (e.g., an SV40 enhancer), response elements, or inducible elements that modulate expression of a nucleic acid. Elements necessary for expression can include a leader or signal sequence. See, for example, SEQ ID NO:156, which is a DAT polypeptide having a leader sequence. Elements necessary for expression also can include, for example, a ribosome binding site for translation initiation, splice donor and acceptor sites, and a transcription terminator. Elements necessary for expression can be of bacterial, yeast, insect, mammalian, or viral origin, and vectors or constructs can contain a combination of elements from different origins. Elements necessary for expression are described, for example, in Goeddel, 1990, *Gene Expression Technology: Methods in Enzymology*, 185, Academic Press, San Diego, Calif.

A vector or construct as described herein further can include sequences such as those encoding a selectable marker (e.g., genes encoding dihydrofolate reductase or genes conferring neomycin resistance for eukaryotic cells; genes conferring tetracycline or ampicillin resistance for *E. coli*; and the gene encoding TRP1 for *S. cerevisiae*), sequences that can be used in purification of an AT or oxidoreductase polypeptide (e.g., 6×His tag), and one or more sequences involved in replication of the vector or construct (e.g., origins of replication). In addition, a vector or construct can contain, for example, one or two regions that have sequence homology for integrating the vector or construct. Vectors and constructs for genomic integration are well known in the art.

As used herein, operably linked means that a promoter and/or other regulatory element(s) are positioned in a vector or construct relative to an AT or oxidoreductase nucleic acid in such a way as to direct or regulate expression of the AT or oxidoreductase nucleic acid. Generally, promoter and other elements necessary for expression that are operably linked to a transcribed sequence are physically contiguous to the transcribed sequence, i.e., they are cis-acting. Some transcriptional regulatory sequences such as enhancers, however, need not be physically contiguous or located in close proximity to the coding sequences whose expression they enhance.

Also provided are host cells. Host cells generally contain a nucleic acid sequence of the invention, e.g., a sequence encoding an AT or an oxidoreductase, or a vector or construct as described herein. The host cell may be any of the host cells familiar to those skilled in the art such as prokaryotic cells or eukaryotic cells including bacterial cells, fungal cells, yeast cells, mammalian cells, insect cells, or plant cells. Exemplary bacterial cells include any species within the genera *Escherichia, Bacillus, Streptomyces, Salmonella, Pseudomonas* and *Staphylococcus*, including, e.g., *E. coli, L. lactis, B. subtilis, B. cereus, S. typhimurium, P. fluorescens*. Exemplary fungal cells include any species of *Aspergillus*, and exemplary yeast cells include any species of *Pichia, Saccharomyces, Schizosaccharomyces*, or *Schwanniomyces*, including *P. pastoris, S. cerevisiae*, or *S. pombe*. Exemplary insect cells include any species of *Spodoptera* or *Drosophila*, including *Drosophila* S2 and *Spodoptera* Sf9. Exemplary animal cells include CHO, COS, Bowes melanoma, C127, 3T3, HeLa and BHK cell lines. See, for example, Gluzman, 1981, *Cell*, 23:175. The selection of an appropriate host is within the abilities of those skilled in the art.

Techniques for introducing nucleic acid into a wide variety of cells are well known and described in the technical and scientific literature. A vector or construct can be introduced into host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis et al., 1986, *Basic Methods in Molecular Biology*). Exemplary methods include $CaPO_4$ precipitation, liposome fusion, lipofection (e.g., LIPOFECTIN™), electroporation, viral infection, etc. The AT or oxidoreductase nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.).

The content of host cells usually is harvested by centrifugation, disrupted by physical or chemical means, and the resulting crude extract retained for further purification. Microbial cells employed for expression of proteins can be disrupted by any convenient method, including freeze-thaw cycling, sonication, mechanical disruption, or the use of cell lysing agents. Such methods are well known to those skilled in the art. The expressed polypeptide or fragment thereof can be recovered and purified from cell cultures by methods including, but not limited to, precipitation (e.g., ammonium sulfate or ethanol), acid extraction, chromatography (e.g., anion or cation exchange, phosphocellulose, hydrophobic interaction, affinity, hydroxylapatite and lectin). If desired, high performance liquid chromatography (HPLC) can be employed for final purification steps.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

An AT or oxidoreductase polypeptide, a fragment, or a variant thereof can be assayed for activity by any number of methods. Methods of detecting or measuring the activity of an enzymatic polypeptide generally include combining a polypeptide, fragment or variant thereof with an appropriate substrate and determining whether the amount of substrate decreases and/or the amount of product or by-product increases. The substrates used to evaluate the activity of DATs disclosed herein typically were tryptophan and/or R-MP, and the products were indole-3-pyruvate and/or R,R-monatin. In addition to a tryptophan or MP substrate, it is expected that polypeptides disclosed herein also will utilize substituted tryptophan and/or MP substrates such as, without limitation, chlorinated tryptophan or 5-hydroxytryptophan. In addition, a by-product of the conversion of MP to monatin (e.g., 4-hydroxy-4-methyl glutamic acid (HMG)) can be monitored or measured.

Methods for evaluating AT activity are described, for example, in Sugio et al., 1995, *Biochemistry*, 34:9661-9669; Ro et al., 1996, *FEBS Lett.*, 398:141-145; or Gutierrez et al., 2000, *Eur. J. Biochem.*, 267, 7218-7223. In addition, methods for evaluating dehydrogenase activity are described, for example, in Lee et al., 2006, *AEM*, 72(2):1588-1594; and Mayer, 2002, *J. Biomolecular Screening*, 7(2):135-140. In addition, methods of evaluating candidate polypeptides for DAT activity are described in Part A and Part B of the Example section herein. For the purposes of determining whether or not a polypeptide falls within the scope of the invention, the methods described in Part B of the Example section are employed.

Typically, an AT or oxidoreductase polypeptide exhibits activity in the range of between about 0.05 to 20 units (e.g., about 0.05, 0.10, 0.20, 0.30, 0.40, 0.50, 0.60, 0.70, 0.80, 0.90, 1.0, 1.5, 2.0, 2.5, 3.0, 3.5, 4.0, 4.5, 5.0, 5.5, 6.0, 6.5, 7, 8, 9, 10, 11, 12, 13, 14, 15, 16, 17, 18, 19 or 19.5 or more units). As used herein, a unit equals one µmol of product released per minute per mg of enzyme. In one embodiment, one unit of activity for an AT polypeptide is one µmol of alpha-keto acid or ketone produced per minute per mg of enzyme (formed from the respective alpha-amino acid or amine). In an alternative embodiment, one unit of activity for an aminotransferase polypeptide is one µmol of alpha-amino acid or amine produced per minute per mg of enzyme (formed from the respective alpha-keto acid or ketone).

The conversion of tryptophan to indole-3-pyruvate or the conversion of MP to monatin using one or more of the AT or oxidoreductase nucleic acids or polypeptides disclosed herein can be performed in vitro or in vivo, in solution or in a host cell, in series or in parallel. When one or more reactions are performed in vitro, the desired ingredients for the reaction(s) can be combined by admixture in an aqueous reaction medium or solution and maintained for a period of time sufficient for the desired product(s) to be produced. Alternatively, one or more AT or oxidoreductase polypeptides used in the one or more of the reactions described herein can be immobilized onto a solid support. Examples of solid supports include those that contain epoxy, aldehyde, chelators, or primary amine groups. Specific examples of suitable solid supports include, but are not limited to, Eupergit® C (Rohm and Haas Company, Philadelphia, Pa.) resin beads and SEPABEADS® EC-EP (Resindion).

To generate indole-3-pyruvate from typtophan or monatin from MP in vivo, an AT or oxidoreductase nucleic acid (e.g., an expression vector) can be introduced into any of the host cells described herein. Depending upon the host cell, many or all of the co-factors (e.g., a metal ion, a co-enzyme, a pyridoxal-phosphate, or a phosphopanthetheine) and/or substrates necessary for the conversion reactions to take place can be provided in the culture medium. After allowing the in vitro or in vivo reaction to proceed, the efficiency of the conversion can be evaluated by determining whether the amount of substrate has decreased or the amount of product has increased.

In some embodiments, the activity of one or more of the AT or oxidoreductase polypeptides disclosed herein can be improved or optimized using any number of strategies known to those of skill in the art. For example, the in vivo or in vitro conditions under which one or more reactions are performed such as pH or temperature can be adjusted to improve or optimize the activity of a polypeptide. In addition, the activity of a polypeptide can be improved or optimized by re-cloning the AT or oxidoreductase nucleic acid into a different vector or construct and/or by using a different host cell. For example, a host cell can be used that has been genetically engineered or selected to exhibit increased uptake or production of tryptophan (see, for example, U.S. Pat. No. 5,728,555). Further, the activity of an AT or oxidoreductase polypeptide can be improved or optimized by ensuring or assisting in the proper folding of the polypeptide (e.g., by using chaperone polypeptides) or in the proper post-translational modifications such as, but not limited to, acetylation, acylation, ADP-ribosylation, amidation, glycosylation, hydroxylation, iodination, methylation, myristolyation, oxidation, pegylation, phosphorylation, prenylation, selenoylation, sulfation, disulfide bond formation, and demethylation as well as covalent attachment of molecules such as flavin, a heme moiety, a nucleotide or nucleotide derivative, a lipid or lipid derivative, and/or a phosphytidylinositol. In addition, the solubility of a polypeptide can be increased using any number of methods known in the art such as, but not limited to, low temperature expression or periplasmic expression.

A number of polypeptides were identified herein that exhibit DAT activity using tryptophan and/or MP as a substrate. Specifically, SEQ ID NO:950, 946, 948, 892, 894, 866, 870, 870 T242N, 872, 874, 878, 880, 882, 884, 902, 910, 918, 176, 178, 154, 220, 156, 216, 238, 224, 230, 232, 214, CbDAT, CaDAT and LsDAT exhibit DAT activity. Notably, SEQ ID NO:946, 892, 894, 220, 176, 1064, 1066 and 1068 exhibited very high activity under the conditions described in Part B of the Examples. It is noted that SEQ ID NO:220 and 894 produced low levels of the HMG by-product during the conversion of MP to monatin.

Use of Aminotransferase or Oxidoreductase Nucleic Acids or Polypeptides in the Production of Monatin One or more of the DAT polypeptides disclosed herein can be used in the production of monatin. Monatin is a high-intensity sweetener having the chemical formula:

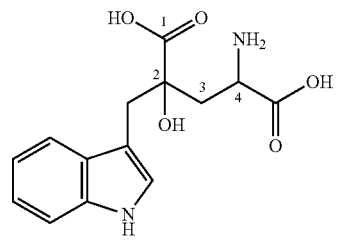 [SMILES: NC(CC(O)(Cc1c[nH]c2ccccc12)C(=O)O)C(=O)O]

Monatin includes two chiral centers leading to four potential stereoisomeric configurations. The R,R configuration (the "R,R stereoisomer" or "R,R monatin"); the S,S configuration (the "S,S stereoisomer" or "S,S monatin"); the R,S configuration (the "R,S stereoisomer" or "R,S monatin"); and the S,R configuration (the "S,R stereoisomer" or "S,R monatin"). As used herein, unless stated otherwise, the term "monatin" is used to refer to compositions including all four stereoisomers of monatin, compositions including any combination of monatin stereoisomers, (e.g., a composition including only the R,R and S,S, stereoisomers of monatin), as well as a single isomeric form (or any of the salts thereof). Due to various numbering systems for monatin, monatin is known by a number of alternative chemical names, including: 2-hydroxy-2-(indol-3-ylmethyl)-4-aminoglutaric acid; 4-amino-2-hydroxy-2-(1H-indol-3-ylmethyl)-pentanedioic acid;

4-hydroxy-4-(3-indolylmethyl)glutamic acid; and, 3-(1-amino-1,3-dicarboxy-3-hydroxy-but-4-yl)indole.

Methods of producing various stereoisomers of monatin (e.g., R,R monatin) are disclosed in, for example, WO 07/133,183 and WO 07/103,389. One or more of the DAT polypeptides disclosed herein, in the presence of tryptophan, can be used in methods known to those of skill in the art to make a monatin composition. As disclosed in both WO 07/133,183 and WO 07/103,389, the conversion of indole-3-pyruvate (or derivatives thereof; see, for example, WO 07/103,389) to 2-hydroxy 2-(indol-3-ylmethyl)-4-keto glutaric acid ("monatin precursor" or "MP") dictates the first chiral center of monatin, while the conversion of MP to monatin dictates the second chiral center. In on embodiment, one or more of the conversions required to produce monatin is catalyzed by more than one enzyme, for example, a mixture of enzymes, so that the resulting composition or preparation contains a desired percentage (e.g., minimum and/or maximum) of one or more of the monatin stereoisomers (e.g., R,R monatin). Alternatively, monatin made by two separate engineered pathways according to the methods of the invention be combined to produce a composition or preparation containing such desired percentage of each monatin stereoisomer(s).

Monatin that is produced utilizing one or more of the AT polypeptides disclosed herein can be at least about 0.5-30% R,R-monatin by weight of the total monatin produced. In other embodiments, the monatin produced using one or more of the polypeptides or biosynthetic pathways disclosed herein, is greater than 30% R,R-monatin, by weight of the total monatin produced; for example, the R,R-monatin is 40%, 50%, 60%, 65%, 70%, 75%, 80%, 85%, 90%, 95% or 99% of the total monatin produced. Alternatively, various amounts of two or more preparations of monatin can be combined so as to result in a preparation that is a desired percentage of R,R-monatin. For example, a monatin preparation that is 30% R,R-monatin can be combined with a monatin preparation that is 90% R,R-monatin; if equal amounts of 30% and 90% R,R-monatin preparations are combined, the resulting monatin preparation would be 60% R,R-monatin.

Monatin produced using one or more of the DAT polypeptides disclosed herein can be for example, a derivative. "Monatin derivatives" have the following structure:

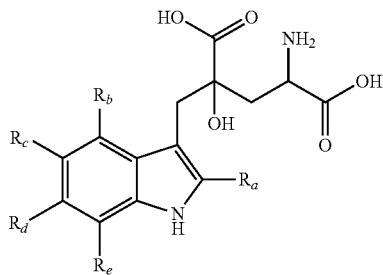

wherein, $R_a$, $R_b$, $R_c$, $R_d$, and $R_e$ each independently represent any substituent selected from a hydrogen atom, a hydroxyl group, a $C_1$-$C_3$ alkyl group, a $C_1$-$C_3$ alkoxy group, an amino group, or a halogen atom, such as an iodine atom, bromine atom, chlorine atom, or fluorine atom. However, $R_a$, $R_b$, $R_c$, $R_d$, and $R_e$ cannot simultaneously all be hydrogen. Alternatively, $R_b$ and $R_c$, and/or $R_d$ and $R_e$ may together form a $C_1$-$C_4$ alkylene group, respectively. "Substituted monatin" refers to, for example, halogenated or chlorinated monatin or monatin derivatives. See, for example, U.S. Publication No. 2005/0118317.

Monatin derivatives also can be used as sweeteners. For example, chlorinated D-tryptophan, particularly 6-chloro-D-tryptophan, which has structural similarities to R,R monatin, has been identified as a non-nutritive sweetener. Similarly, halogenated and hydroxy-substituted forms of monatin have been found to be sweet. See, for example, U.S. Publication No. 2005/0118317. Substituted indoles have been shown in the literature to be suitable substrates for PLP-enzymes and have yielded substituted tryptophans. See, for example, Fukuda et al., 1971, *Appl. Environ. Microbiol.*, 21:841-43. The halogen does not appear to sterically hinder the catalytic mechanism or the enantiospecificity of the enzyme. Therefore, halogens and hydroxyl groups should be substitutable for hydrogen, particularly on positions 1-4 of the benzene ring in the indole of tryptophan, without interfering in subsequent conversions to D- or L-tryptophan, indole-3-pyruvate, MP, or monatin.

One or more of the DAT polypeptides disclosed herein, with or without one or more additional polypeptides, can be used in the production of monatin. A DAT polypeptide (or nucleic acid molecule encoding such a DAT polypeptide) can be used in the conversion of tryptophan to indole-3-pyruvic acid (in the presence of an amino acceptor) and in the conversion of MP to monatin. The intermediate step between those two reactions is the conversion of indole-3-pyruvic acid to MP, which requires the presence of a C3 carbon source such as pyruvate, oxaloacetate or serine. The use of a DAT polypeptide in the conversion step from MP to monatin results in the R configuration at the second chiral center. It is noted that SEQ ID NO:946, 950, 220 and 948 produced high amounts of R,R monatin.

The conversion of indole-3-pyruvate (or indole-3-pyruvic acid) to MP can occur in the absence of an enzyme (i.e., an aldol condensation), but also can be facilitated by a polypeptide. The chirality at the first chiral center is determined by the enantiospecificity of the reaction converting indole-3-pyruvate to MP. If the MP formation reaction is not facilitated by an enzyme, a racemic mixture of R-MP and S-MP is typically formed in the absence of a chiral auxiliary. Enzymes that facilitate the conversion of indole-3-pyruvate to MP include, for example, a synthase/lyase (EC 4.1.3.- and 4.1.2.-), specifically those in classes EC 4.1.3.16 and EC 4.1.3.17. These classes include carbon-carbon synthases/lyases, such as aldolases that catalyze the condensation of two carboxylic acid substrates. Enzyme class EC 4.1.3.- are those synthases/lyases that form carbon-carbon bonds utilizing oxo-acid substrates (such as indole-3-pyruvate) as the electrophile, while EC 4.1.2.- are synthases/lyases that form carbon-carbon bonds utilizing aldehyde substrates (such as benzaldehyde) as the electrophile. For example, KHG aldolase (EC 4.1.3.16) and HMG aldolase (EC 4.1.3.17), are known to convert indole-3-pyruvate and pyruvate to MP. Herein, the term HMG aldolase is used to mean any polypeptide with 4-hydroxy-4-methyl-2-oxoglutarate aldolase activity. Suitable examples of HMG aldolases include *Comamonas testosteroni* ProA and *Sinorhizobium meliloti* ProA (NCBI Accession No. CAC46344).

When one or more of the conversion reactions in the pathway to producing monatin are to be performed in vivo, a person of ordinary skill in the art may optimize production of monatin in a microorganism, including R,R monatin, by various routine methods. Such a microorganism can be one that naturally is better than other microorganisms in one or more of the following characteristics, or that has been modified to exhibit one or more of the following characterisitics, which typically result in improved production of monatin (relative to the microorganism before such modification). Such characteristics include, without limitation, an increase in the ability of a microorganism to take-up tryptophan (e.g., D-tryptophan); an increase in the ability of a microorganism to take-up indole-3-pyruvate; a decrease in the ability of a microorganism to secrete indole-3-pyruvate; a decrease in the amount of degradation of indole-3-pyruvate in the microorganism; and/or a decrease in the toxicity of D-tryptophan to a microorganism. Such characteristics and strategies for obtaining microorganisms exhibiting one or more such characteristics are described in, for example, WO 07/133,183 and WO 07/103,389.

Monatin, or an intermediate of the tryptophan to monatin biosynthetic pathway (including indole-3-pyruvate and MP) produced using one or more of the AT or oxidoreductase polypeptides disclosed herein can be purified from the components of the reaction. In one embodiment, the monatin or an intermediate can be purified simply by removing the substance that is to be purified from the enzyme preparation in which it was synthesized. In other embodiments, monatin or an intermediate is purified from a preparation in which it was synthesized so that the resulting "purified" composition or preparation is at least about 5-60% monatin by weight of total organic compounds. In another embodiment, the monatin or an intermediate can be purified to a degree of purity of at least about 70%, 80%, 90%, 95% or 99% by weight of total organic compounds. The monatin produced using one or more of the polypeptides or biosynthetic pathways disclosed herein can be purified from the components of the reaction by any method known to a person of ordinary skill in the art (e.g., repeatedly recrystallization).

In accordance with the present invention, there may be employed conventional molecular biology, microbiology, biochemical, and chemical techniques within the skill of the art. Such techniques are explained fully in the literature. The invention will be further described in the following examples, which do not limit the scope of the invention described in the claims.

EXAMPLES

The aminotransferases and oxidoreductases described herein were obtained using a selection strategy. In this selection strategy, environmental DNA libraries were constructed in a bacterial host strain that exhibits L-tryptophan auxotrophy. Library clones were innoculated onto media containing D-tryptophan (but lacking L-tryptophan). The only clones that could grow are those that expressed a gene on one of the discrete environmental DNA fragments that encoded an enzyme active on D-tryptophan. For example, clones were identified that expressed an active tryptophan racemase and were able to convert D-tryptophan to L-tryptophan. Additionally, clones were identified that expressed an oxidoreductase (such as an amino acid oxidase or a dehydrogenase) that could convert D-tryptophan to an intermediate that the host cell could, in turn, convert to L-tryptophan. In the case of oxidoreductases such as amino acid oxidases and dehydrogenases, one such intermediate is indole-3-pyruvate.

The Examples in Part A describe the methodologies used for initial characterization of the candidate DAT and oxidoreductase nucleic acids and the encoded polypeptides. Further characterization of particular nucleic acids and polypeptides is described in Part B.

Part A

Example 1

Growth and Assay Procedures #1

Enzyme Preparation

Glycerol stocks were used to inoculate flasks containing 50 mL of LB medium with the appropriate antibiotic. The starter cultures were grown overnight at 37° C. with shaking at 230 rpm and the $OD_{600nm}$ was checked. The starter culture was used to inoculate 400 mL to $OD_{600nm}$ of 0.05. The culture was incubated at 37° C. with shaking at 230 rpm.

Cultures were induced with 1 mM IPTG when the $OD_{600nm}$ was between 0.5 and 0.8 and incubated at 30° C. and 230 rpm overnight. Cultures were harvested by pelleting cells by centrifugation at 4000 rpm for 15 minutes. The supernatant was poured off and the pellet was either frozen for later use or resuspended in 20 mL of 50 mM sodium phosphate buffer (pH 7.5) supplemented with 26 U/mL of DNAse and lysed using a microfluidizer (Microfluidics Corporation, Newton, Mass.) per the manufacturer's instructions. The clarified lysate was collected and centrifuged at 11,000 rpm for 30 minutes. The supernatant was collected in a clean tube and filtered through a 0.2 µm filter. Five mL aliquots of the clarified lysate were placed in a vial and freeze-dried using a lyophilizer (Virtis Company, Gardinier, N.Y.) per the manufacturer's instructions. Approximately 1 mL of the clarified lysate was retained for protein quantitation using the Bio-Rad Protein Assay Reagent (Bio-Rad, Hercules, Calif.) and SDS-PAGE analysis. Then, the amount of protein in each lyophilized sample was calculated.

Activity Assay

Enzymes for activity assays were prepared in 50 mM sodium phosphate pH 7.5. DAT assays were usually performed using approximately 1 mg/mL total protein.

DAT Assay Using RR-Monatin Substrate

Twenty-five mM RR-monatin, 25 mM pyruvic acid sodium salt, 0.08 mM PLP, 90 mM sodium phosphate pH 8.0 and 0.8 mg/mL DAT (total protein) prepared as described above (under 'Enzyme Preparation' section) were combined and incubated at 30° C. at 300 rpm. At various timepoints (generally 0, 2, 4, and 24 hours), 50 µL of the reaction product was transferred to 150 µL of ice cold acetonitrile, and the sample vortexed for 30 seconds. Samples were centrifuged at 13,200 rpm for 10 minutes at 4° C., and the supernatant was passed through a 0.45 µm filter. The filtrate was diluted 10-fold in methanol, and samples were analyzed by LC/MS/MS to monitor the D-alanine formed (described in this Example below under 'LC/MS/MS method for detecting D-alanine or R,R-monatin' section).

DAT Assay Using Tryptophan Substrate

Ten mM D-tryptophan, 25 mM pyruvic acid sodium salt, 0.08 mM PLP, 90 mM sodium phosphate pH 8.0, and 0.8 mg/mL DAT (total protein) prepared as described above (under 'Enzyme Preparation' section) were combined and incubated at 30° C. and 300 rpm. At timepoints (generally 0, 2, 4, and 24 hours), 50 µL of the reaction product was transferred to 150 µL of ice cold acetonitrile, vortexed for 30 seconds, and centrifuged at 13,200 rpm for 10 minutes at 4° C. The supernatant was passed through a 0.45 µm filter and the filtrate was diluted 10-fold in methanol. Samples were analyzed by LC/MS/MS to monitor the D-alanine formed (described in this Example below under 'LC/MS/MS method for detecting D-alanine or R,R-monatin' section).

LC/MS/MS Method for Detecting D-Alanine or R,R-Monatin

LC/MS/MS screening was achieved by injecting samples from 96-well plates using a CTCPal auto-sampler (LEAP Technologies, Carrboro, N.C.) into a 30/70H$_2$O/Acn (0.1% formic acid) mixture provided by LC-10ADvp pumps (Shimadzu, Kyoto, Japan) at 1.0 mL/min through a Zorbax Eclipse XDB-C8 (2.1×50 mm) column and into the API4000 TurboIon-Spray triple-quad mass spectrometer (Applied Biosystems, Foster City, Calif.).

Ion spray and Multiple Reaction Monitoring (MRM) were performed for the analytes of interest in the positive ion mode. alanine: parent/daughter ions: 90.12/44.25 monatin: parent/daughter ions: 293.11/130.15.

Example 2

Activity of DATs Using Assay Procedures #1

The vector pSE420-cHis is a derivative of pSE420 (Invitrogen, Carlsbad, Calif.). For pSE420-cHis, the vector was cut with NcoI and Hind III, and ligated with C-His. C-His: 5'-CCA TGG GAG GAT CCA GAT CTC ATC ACC ATC ACC ATC ACT AAG CTT (SEQ ID NO:977). The expression of the His-tag in this vector depends on the choice of host and stop codon. That is, if a TAG stop codon and a supE host are used, the His-tag is expressed; if a TAG stop codon and a non supE host are used, the His-tag is not expressed. Unless indicated otherwise, the His-tag was not expressed in these experiments.

The DAT subclones were in the pSE420-cHis vector/*E. coli* HMS174 host (Novagen, San Diego, Calif.) with the exception of the following subclones: SEQ ID NO:930, 932, 936 were in the pET101 D-Topo vector/BL21Star(DE3) host (Invitrogen, Carlsbad, Calif.); SEQ ID NO:934 was in the pET101 D-Topo vector/BL21 Codon PlusRIL host (Stratagene, La Jolla, Calif.); SEQ ID NO:938, 942, 944, 946 were in the pSE420 vector/XL1Blue host (Stratagene, La Jolla, Calif.); SEQ ID NO:940, 948, 950, 962 and 966 were in the pSE420-c-His vector/XL1Blue host (Stratagene, La Jolla, Calif.); and SEQ ID NO:928 was in the pQET1 vector/M15pREP4 host (pQET1 described in U.S. Pat. Nos. 5,814,473 and 6,074,860; M15pREP4 from Qiagen; Valencia, Calif.).

The subclones were grown, lysed and lyophilized according to the procedures described in Example 1. Samples were tested for activity on R,R-monatin as well as D-tryptophan (as described in Example 1). For the monatin DAT assay, DATs were incubated with 25 mM R,R-monatin, 25 mM pyruvic acid sodium salt, and 0.08 mM PLP (pH 8) at 30° C. For the D-tryptophan DAT assay, DATs were incubated with 10 mM D-tryptophan, 25 mM pyruvic acid sodium salt, and 0.08 mM PLP (pH 8) at 30° C. All DATs were loaded at 0.8 mg/mL total protein in both assays.

At indicated timepoints, 50 μL of the reaction product was added to 150 μL of ice-cold acetonitrile. Samples were vortexed for 30 seconds and the supernatant was then diluted ten-fold in methanol. Samples were then analyzed by LC/MS/MS (as described in Example 1) to monitor the D-alanine formed. The tables below show the D-aminotransferase activity on both substrates.

TABLE 1

Activity of D-aminotransferase subclones on R,R-monatin and D-tryptophan

| SEQ ID NO: | Activity on R,R-monatin μg/mL D-alanine formed at indicated hour | Activity on D-tryptophan μg/mL D-alanine formed at indicated hour | Relative Expression |
|---|---|---|---|
| 928 | 30@24 hr | NT | + |
| 938 | 122@24 hr | NT | ++ |
| 940 | 5@24 hr | NT | ND |
| 942 | 12@24 hr | NT | ND |
| 944 | 75@24 hr | NT | ND |
| 946 | 39@24 hr | NT | ND |
| 948 | 200@0.5 hr | 441@0.5 hr | ND |
| 950 | 75@0.5 hr | 452@0.5 hr | ND |
| 962 | NT | NT | + |
| 964 | 7@24 hr | ND@24 hr | ++ |
| 966 | NT | NT | ++ |
| 968 | 6.7@24 hr | 52@24 hr | +++ |
| 886 (expressed in XL1Blue cells) | NT | NT | ++ |
| 886 (expressed in *E. coli* HMS174 cells) | 15.4@24 hr | 143@24 hr | +++ |

NT, not tested;
ND, not detected under conditions used;
+, low expression,
++, moderate expression,
+++, high expression

| Subclone name | Activity on R,R-monatin μg/mL D-alanine formed at indicated hour | Activity on D-tryptophan μg/mL D-alanine formed at indicated hour | Relative Expression |
|---|---|---|---|
| 888 (expressed in XL1 Blue cells) | NT | NT | ++ |
| 888 (expressed in HMS174 cells) | 7@24 hr | 317@24 hr | +++ |
| 890 (expressed in XL1 Blue cells) | NT | NT | ++ |
| 890 (expressed in HMS174 cells) | 54@24 hr | 278@24 hr | +++ |
| 892 (expressed in XL1 Blue cells) | NT | NT | + |
| 892 (expressed in HMS174 cells) | 113@24 hr | <5@24 hr | ++ |
| 894 (expressed in XL1 Blue cells) | NT | NT | ND |
| 894 (expressed in HMS174 cells) | 16@24 hr | 116@24 hr | + |
| 866 | 28@24 hr | NT | +++ |
| 868 | <1@24 hr | NT | +++ |
| 970 | 10.8@24 hr | NT | + |
| 870 | 123.5@24 hr | NT | +++ |
| 872 | 62.3@24 hr | NT | +++ |
| 874 | 46.5@24 hr | NT | +++ |
| 876 | 44@24 hr | NT | ++ |
| 878 | 37@24 hr | NT | +++ |
| 972 | <5@24 hr | NT | + |
| 880 | 72.4@24 hr | 79.6@24 hr | + |
| 882 | 158.8@24 hr | 344@2 hr | +++ |
| 884 | 290@24 hr | 363@2 hr | ++ |
| 896 | 54@24 hr | 450@2 hr | +++ |
| 898 | 466@24 hr | 300@24 hr | + |
| 900 | 135@24 hr | 154@24 hr | + |
| 902 | 280@24 hr | 130@24 hr | ++ |
| 904 | 170@24 hr | 140@24 hr | + |
| 906 | 700@24 hr | 500@24 hr | +++ |
| 908 | 55@24 hr | 45@24 hr | + insoluble |
| 910 | 384@24 hr | 240@24 hr | +++ |
| 912 | NT | NT | ND |
| 914 | NT | NT | ND |
| 916 | NT | NT | ND |
| 918 | NT | NT | ND |
| 920 | NT | NT | ND |
| 922 | NT | NT | ND |

TABLE 1-continued

| | | | |
|---|---|---|---|
| 924 | NT | NT | ND |
| 926 | NT | NT | ND |
| 974 (expressed in HMS174 cells) | NT | NT | ND |
| 974 (expressed in XL1 Blue cells) | NT | NT | ND |
| 930 | NT | NT | ND |
| 932 | NT | NT | ND |
| 934 | NT | NT | ND |
| 936 | NT | NT | ND |
| 976 (expressed in LX1 Blue cells) | NT | <5@24 hr | ++ |

NT, not tested;
ND, not detected;
+, low expression;
++, moderate expression;
+++, high expression It should be noted that there are only very conservative differences between the subclones listed above and their native sequences that are also in the sequence listing. For example, quite often, a start or stop codon was modified to be more efficient for expression in *E. coli*. It is expected that cloning of the wildtype sequences would give similar results in terms of DAT activity. For clarification purposes, the following table shows the relationship between a number of the clones and subclones described herein.

| Clone/subclone pair | SEQ ID NO: | Activity | Sequence type (clone or subclone) |
|---|---|---|---|
| 1 | 31, 32 | D-AT | Clone |
| 1 | 867, 868 | D-AT | Subclone |
| 2 | 955, 956 | D-AT | Clone |
| 2 | 929, 930 | D-AT | Subclone |
| 3 | 957, 958 | D-AT | Clone |
| 3 | 931, 932 | D-AT | Subclone |
| 4 | 959, 960 | D-AT | Clone |
| 4 | 935, 936 | D-AT | Subclone |
| 5 | 41, 42 | D-AT | Clone |
| 5 | 869, 870 | D-AT | Subclone |
| 6 | 7, 8 | D-AT | Clone |
| 6 | 943, 944 | D-AT | Subclone |
| 7 | 11, 12 | D-AT | Clone |
| 7 | 941, 942 | D-AT | Subclone |
| 8 | 83, 84 | D-AT | Clone |
| 8 | 879, 880 | D-AT | Subclone |
| 9 | 151, 152 | D-AT | Clone |
| 9 | 913, 914 | D-AT | Subclone |
| 10 | 951, 952 | D-AT | Clone |
| 10 | 933, 934 | D-AT | Subclone |
| 11 | 75, 76 | D-AT | Clone |
| 11 | 881, 882 | D-AT | Subclone |
| 12 | 87, 88 | D-AT | Clone |
| 12 | 883, 884 | D-AT | Subclone |
| 13 | 163, 164 | D-AT | Clone |
| 13 | 921, 922 | D-AT | Subclone |
| 14 | 145, 146 | D-AT | Clone |
| 14 | 919, 920 | D-AT | Subclone |
| 15 | 149, 150 | D-AT | Clone |
| 15 | 925, 926 | D-AT | Subclone |
| 16 | 147, 148 | D-AT | Clone |
| 16 | 915, 916 | D-AT | Subclone |
| 17 | 15, 16 | D-AT | Clone |
| 17 | 947, 948 | D-AT | Subclone |
| 18 | 17, 18 | D-AT | Clone |
| 18 | 949, 950 | D-AT | Subclone |
| 19 | 3, 4 | D-AT | Clone |
| 19 | 937, 938 | D-AT | Subclone |
| 20 | 5, 6 | D-AT | Clone |
| 20 | 939, 940 | D-AT | Subclone |
| 21 | 161, 162 | D-AT | Clone |
| 21 | 923, 924 | D-AT | Subclone |
| 22 | 953, 954 | D-AT | Clone |
| 22 | 927, 928 | D-AT | Subclone |
| 23 | 19, 20 | D-AT | Clone |
| 23 | 885, 886 | D-AT | Subclone |
| 24 | 21, 22 | D-AT | Clone |
| 24 | 891, 892 | D-AT | Subclone |
| 25 | 23, 24 | D-AT | Clone |
| 25 | 893, 894 | D-AT | Subclone |
| 26 | 13, 14 | D-AT | Clone |
| 26 | 945, 946 | D-AT | Subclone |
| 27 | 143, 144 | D-AT | Clone |
| 27 | 917, 918 | D-AT | Subclone |
| 28 | 43, 44 | D-AT | Clone |
| 28 | 871, 872 | D-AT | Subclone |
| 29 | 45, 46 | D-AT | Clone |
| 29 | 873, 874 | D-AT | Subclone |
| 30 | 49, 50 | D-AT | Clone |
| 30 | 897, 898 | D-AT | Subclone |
| 31 | 51, 52 | D-AT | Clone |
| 31 | 875, 876 | D-AT | Subclone |
| 32 | 37, 38 | D-AT | Clone |
| 32 | 877, 878 | D-AT | Subclone |
| 33 | 25, 26 | D-AT | Clone |
| 33 | 889, 890 | D-AT | Subclone |
| 34 | 27, 28 | D-AT | Clone |
| 34 | 887, 888 | D-AT | Subclone |
| 35 | 131, 132 | D-AT | Clone |
| 35 | 909, 910 | D-AT | Subclone |
| 36 | 53, 54 | D-AT | Clone |
| 36 | 865, 866 | D-AT | Subclone |
| 37 | 29, 30 | D-AT | Clone |
| 37 | 895, 896 | D-AT | Subclone |
| 38 | 125, 126 | D-AT | Clone |
| 38 | 907, 908 | D-AT | Subclone |
| 39 | 133, 134 | D-AT | Clone |
| 39 | 911, 912 | D-AT | Subclone |
| 40 | 127, 128 | D-AT | Clone |
| 40 | 899, 900 | D-AT | Subclone |
| 41 | 137, 138 | D-AT | Clone |
| 41 | 901, 902 | D-AT | Subclone |
| 42 | 139, 140 | D-AT | Clone |
| 42 | 903, 904 | D-AT | Subclone |
| 43 | 129, 130 | D-AT | Clone |
| 43 | 905, 906 | D-AT | Subclone |
| 44 | 33, 34 | D-AT | Clone |
| 44 | 969, 970 | D-AT | Subclone |
| 45 | 219, 220 | D-AT | Clone |
| 45 | 973, 974 | D-AT | Subclone |
| 46 | 39, 40 | D-AT | Clone |
| 46 | 971, 972 | D-AT | Subclone |
| 47 | 1, 2 | D-AT | Clone |
| 47 | 975, 976 | D-AT | Subclone |
| 48 | 253, 254 | Dehydrogenase | Clone |
| 48 | 961, 962 | Dehydrogenase | Subclone |

Part B

Example 3

Detection of Monatin, MP, Tryptophan, Alanine, and HMG

This example describes the analytical methodology associated with the further characterization of selected D-aminotransferase (DAT) enzymes.
LC/MS/MS Multiple Reaction Monitoring (MRM) Analysis of Monatin and Tryptophan
Analyses of mixtures for monatin and tryptophan derived from biochemical reactions were performed using a Waters/Micromass® liquid chromatography-tandem mass spectrometry (LC/MS/MS) instrument including a Waters 2795 liquid chromatograph with a Waters 996 Photo-Diode Array (PDA)

absorbance monitor placed in series between the chromatograph and a Micromass® Quattro Ultima® triple quadrupole mass spectrometer. LC separations were made using an Xterra MS C8 reversed-phase chromatography column, 2.1 mm×250 mm at 40° C. The LC mobile phase consisted of A) water containing 0.3% formic acid and 10 mM ammonium formate and B) methanol containing 0.3% formic acid and 10 mM ammonium formate.

The gradient elution was linear from 5% B to 45% B, 0-8.5 min, linear from 45% B to 90% B, 8.5-9 min, isocratic from 90% B to 90% B, 9-12.5 min, linear from 90% B to 5% B, 12.5-13 min, with a 4 min re-equilibration period between runs. The flow rate was 0.27 mL/min, and PDA absorbance was monitored from 210 nm to 400 nm. All parameters of the ESI-MS were optimized and selected based on generation of protonated molecular ions ([M+H]+) of the analytes of interest, and production of characteristic fragment ions. The following instrumental parameters were used for LC/MS/MS Multiple Reaction Monitoring (MRM) analysis of monatin and tryptophan: Capillary: 3.5 kV; Cone: 40 V; Hex 1: 20 V; Aperture: 0 V; Hex 2: 0 V; Source temperature: 100° C.; Desolvation temperature: 350° C.; Desolvation gas: 500 L/h; Cone gas: 50 L/h; Low mass resolution (Q1): 12.0; High mass resolution (Q1): 12.0; Ion energy: 0.2; Entrance: −5 V; Collision Energy: 8; Exit: 1 V; Low mass resolution (Q2): 15; High mass resolution (Q2): 15; Ion energy (Q2): 3.5; Multiplier: 650. Four monatin-specific parent-to-daughter MRM transitions and one tryptophan specific parent-to-daughter transition are used to specifically detect monatin and tryptophan in in vitro and in vivo reactions. The transitions monitored are 293.08 to 157.94, 293.08 to 167.94, 293.08 to 130.01, and 293.08 to 256.77. Tryptophan is monitored with the MRM transition 205.0 to 146.0. For internal standard quantification of monatin and tryptophan, four calibration standards containing four different ratios of each analyte to $d_5$-tryptophan and $d_5$-monatin, are analyzed. These data are subjected to a linear least squares analysis to form a calibration curve for monatin and tryptophan. To each sample is added a fixed amount of $d_5$-tryptophan and $d_5$-monatin ($d_5$-monatin was synthesized from $d_5$-tryptophan according to the methods from WO 2003/091396 A2), and the response ratios (monatin/$d_5$-monatin; tryptophan/$d_5$-tryptophan) in conjunction with the calibration curves described above are used to calculate the amount of each analyte in the mixtures. Parent-to-daughter mass transitions monitored for $d_5$-tryptophan and $d_5$-monatin are 210.0 to 150.0, and 298.1 to 172.0 and 298.1 to 162.00 respectively.

Chiral LC/MS/MS (MRM) Measurement of Monatin

Determination of the stereoisomer distribution of monatin in biochemical reactions was accomplished by derivatization with 1-fluoro-2-4-dinitrophenyl-5-L-alanine amide (FDAA), followed by reversed-phase LC/MS/MS MRM measurement.

Derivatization of Monatin with FDAA

To 50 µL of sample or standard and 10 µL of internal standard was added 100 µL of a 1% solution of FDAA in acetone. Twenty µL of 1.0 M sodium bicarbonate was added, and the mixture was incubated for 1 h at 40° C. with occasional mixing. The sample was removed and cooled, and neutralized with 20 µL of 2.0 M HCl (more HCl may be required to effect neutralization of a buffered biological mixture). After degassing was complete, samples were ready for analysis by LC/MS/MS.

LC/MS/MS Multiple Reaction Monitoring for the Determination of the Stereoisomer Distribution of Monatin Analyses were performed using the LC/MS/MS instrumentation described in the previous sections. The LC separations capable of separating all four stereoisomers of monatin (specifically FDAA-monatin) were performed on a Phenomenex Luna® 2.0×250 mm (3 µm) C18 reversed phase chromatography column at 40° C. The LC mobile phase consisted of A) water containing 0.05% (mass/volume) ammonium acetate and B) acetonitrile. The elution was isocratic at 13% B, 0-2 min, linear from 13% B to 30% B, 2-15 min, linear from 30% B to 80% B, 15-16 min, isocratic at 80% B 16-21 min, and linear from 80% B to 13% B, 21-22 min, with a 8 min re-equilibration period between runs. The flow rate was 0.23 mL/min, and PDA absorbance was monitored from 200 nm to 400 nm. All parameters of the ESI-MS were optimized and selected based on generation of deprotonated molecular ions ([M−H]−) of FDAA-monatin, and production of characteristic fragment ions.

The following instrumental parameters were used for LC/MS analysis of monatin in the negative ion ESI/MS mode: Capillary: 3.0 kV; Cone: 40 V; Hex 1: 15 V; Aperture: 0.1 V; Hex 2: 0.1 V; Source temperature: 120° C.; Desolvation temperature: 350° C.; Desolvation gas: 662 L/h; Cone gas: 42 L/h; Low mass resolution (Q1): 14.0; High mass resolution (Q1): 15.0; Ion energy: 0.5; Entrance: 0 V; Collision Energy: 20; Exit: 0 V; Low mass resolution (Q2): 15; High mass resolution (Q2): 14; Ion energy (Q2): 2.0; Multiplier: 650. Three FDAA-monatin-specific parent-to-daughter transitions were used to specifically detect FDAA-monatin in in vitro and in vivo reactions. The transitions monitored for monatin were 542.97 to 267.94, 542.97 to 499.07, and 542.97 to 525.04. Monatin internal standard derivative mass transition monitored was 548.2 to 530.2. Identification of FDAA-monatin stereoisomers was based on chromatographic retention time as compared to purified monatin stereoisomers, and mass spectral data. An internal standard was used to monitor the progress of the reaction and for confirmation of retention time of the S,S stereoisomer.

Liquid Chromatography-Post Column Fluorescence Detection of Amino Acids, Including Tryptophan, Monatin, Alanine, and HMG Procedure for Trytophan, Monatin, and Alanine Liquid chromatography with post-column fluorescence detection for the determination of amino acids in biochemical reactions was performed on a Waters 2690 LC system or equivalent combined with a Waters 474 scanning fluorescence detector, and a Waters post-column reaction module (LC/OPA method). The LC separations were performed on an Interaction-Sodium loaded ion exchange column at 60° C. Mobile phase A was Pickering Na 328 buffer (Pickering Laboratories, Inc.; Mountain View, Calif.). Mobile phase B was Pickering Na 740 buffer. The gradient elution was from 0% B to 100% B, 0-20 min, isocratic at 100% B, 20-30 min, and linear from 100% B to 0% B, 30-31 min, with a 20 min re-equilibration period between runs. The flow rate for the mobile phase was 0.5 mL/min. The flow rate for the OPA post-column derivatization solution was 0.5 mL/min. The fluorescence detector settings were EX 338 nm and Em 425 nm. Norleucine was employed as an internal standard for the analysis. Identification of amino acids was based on chromatographic retention time data for purified standards.

Procedure for HMG

Samples from biochemical reactions were cleaned up by solid phase extraction (SPE) cartridges containing C18 as the packing material and 0.6% acetic acid as the eluent. The collected fraction from SPE was then brought up to a known volume and analyzed using HPLC post-column O-Phthaladehyde (OPA) derivatization with a florescence detector. Chromatographic separation was made possible using a Waters 2695 liquid chromatography system and two Phenomenex AquaC18 columns in series; a 2.1 mm×250 mm column with 5 µm particles, and a 2.1 mm×150 mm column with 3 µm particles. The temperature of the column was 40° C. and the column isocratic flow rate was 0.18 mL/min. The mobile phase was 0.6% acetic acid. OPA post-column derivatization and detection system consists of a Waters Reagent Manager (RMA), a reaction coil chamber, a temperature control module for the reaction coil chamber, and a Waters 2847 Florescent detector. The OPA flow rate was set at 0.16 mL/min, and the reaction coil chamber was set to 80° C. The florescence detector was set with an excitation wavelength of 348 nm and an emission wavelength of 450 nm. Other parameters controlling detector sensitivity, such as signal gain and attenuation, were set to experimental needs. Quantification of HMG was based off of the molar response of glutamic acid.

Detection of MP by LC/MS

Liquid chromatography separations were made using Waters 2690 liquid chromatography system and a 2.1 mm×50 mm Agilent Eclipse XDB-C18 1.8 μm reversed-phase chromatography column with flow rate at 0.25 mL/min and gradient conditions as follows:

| Time (min) | A % | B % |
|---|---|---|
| 0.00 | 95 | 5 |
| 0.2 | 95 | 5 |
| 1.2 | 5 | 95 |
| 4.5 | 5 | 95 |
| 5.0 | 95 | 5 |
| 10 | 95 | 5 |

The mobile phase A was 0.3% (v/v) formic acid with 10 mM ammonium formate, and mobile phase B was 0.3% formic acid w/10 mM ammonium formate in 50:50 methanol/acetonitrile. The column temperature was 40° C.

Parameters for the Micromass ZQ quadrupole mass spectrometer operating in negative electrospray ionization mode (-ESI) were set as follows: Capillary: 2.2 kV; Cone: 35 V; Extractor: 4 V; RF lens: 1 V; Source temperature: 120° C.; Desolvation temperature: 380° C.; Desolvation gas: 600 L/h; Cone gas: Off; Low mass resolution: 15.0; High mass resolution: 15.0; Ion energy: 0.2; Multiplier: 650. Single ion monitoring MS experiment was set up to allow detection selectively for m/z 290.3, 210.3, 184.3, and 208.4. The m/z 208.4 is the deprotonated molecular [M−H]⁻ ion of the internal standard $d_5$-tryptophan.

Detection of MP by LC/MS/MS

LC separations were made using Waters HPLC liquid chromatography system and a 2.1 mm×50 mm Agilent Eclipse XDB-C18 1.8 μm reversed-phase chromatography column with flow rate at 0.25 mL/min and gradient conditions are as follows:

| Time (min) | A % | B % |
|---|---|---|
| 0.00 | 95 | 5 |
| 0.7 | 95 | 5 |
| 3.0 | 5 | 95 |
| 4.0 | 5 | 95 |
| 4.3 | 95 | 5 |
| 6.0 | 95 | 5 |

Mobile phase A was 0.3% (v/v) formic acid with 10 mM ammonium formate, and B was 0.3% formic acid with 10 mM ammonium formate in 50:50 methanol/acetonitrile. The column temperature was 40° C.

Parameters on Waters Premier XE triple quadrupole mass spectrometer for LC/MS/MS Multiple Reaction Monitoring (MRM) experiments operating in negative electrospray ionization mode (-ESI) were set as the following: Capillary: 3.0 kV; Cone: 25 V; Extractor: 3 V; RF lens: 0 V; Source temperature: 120° C.; Desolvation temperature: 350° C.; Desolvation gas: 650 L/hr; Cone gas: 47 L/hr; Low mass resolution (Q1): 13.5; High mass resolution (Q1): 13.5; Ion energy (Q1): 0.5 V; Entrance: 1 V; Collision Energy: 18 V; Exit 1: 19; Low mass resolution (Q2): 15; High mass resolution (Q2): 15; Ion Energy (Q2): 2.0; Multiplier: 650. Four parent-to-daughter MRM transitions were monitored to selectively detect Monatin precursor (MP) and $d_5$-Monatin precursor ($d_5$-MP); $d_5$-MP was used as an internal standard (I.S.). The four MRM transitions were 290.1 to 184.1, 290.1 to 210.1, 290.1 to 228.1, and 295.1 to 189.1. Two of these transitions, 290.1 to 184.1 for MP, and 295.1 to 189.1 for $d_5$-MP, were used for generating calibration curves and for quantification purposes. Transitions of 290.1 to 210.1 and 290.1 to 228.1 were used as qualitative secondary confirmation of MP.

Production of Monatin and MP for Standards and for Assays

Production of Monatin

A racemic mixture of R,R and S,S monatin was synthetically produced as described in U.S. Pat. No. 5,128,482. The R,R and S,S monatin were separated by a derivatization and a hydrolysis step. Briefly, the monatin racemic mixture was esterified, the free amino group was blocked with carbamazepine (CBZ), a lactone was formed, and the S,S lactone was selectively hydrolyzed using an immobilized protease enzyme. The monatin can also be separated as described in Bassoli et al., *Eur. J. Org. Chem.*, 8:1652-1658, (2005).

MP Production

R-MP was produced by the transamination of R,R monatin using AT-103 broad range D-aminotransferase (BioCatalytics, Pasadena, Calif.) in 0.1 M potassium phosphate buffer, using sodium pyruvate as the amino acceptor. S-MP was produced by the transamination of S,S monatin using AT-102 L-aminotransferase (BioCatalytics) in 0.1 M potassium phosphate buffer, using sodium pyruvate as the amino acceptor. Both reactions were carried out at 30° C. and at a pH of approximately 8.0-8.3, for approximately 20 hours. Both compounds were purified using preparative scale HPLC with a Rohm and Haas (Philadelphia, Pa.) hydrophobic resin (XAD™ 1600), eluting in water. Samples containing greater than 90% purity monatin precursor were collected and freeze-dried.

Example 4

Protein Preparation Methods

This example describes the methodology used for cloning, expression, cell extract preparation, protein purification, and protein quantification for secondary characterization of selected DATs.

Those of skill in the art would realize that the presence of activity in a polypeptide encoded from a subcloned (e.g., a fragment) or otherwise modified (e.g., tagged) nucleic acid is considered predictive of the presence of activity in the corresponding polypeptide encoded from the full-length or wild type nucleic acid.

Amplification of DAT-Encoding Genes for Cloning into Topo Plasmids

PCR reactions for Topo cloning (using either Pfu Turbo or Cloned Pfu from Stratagene) were as follows: 1× recommended buffer for the polymerase enzyme, 0.2 mM dNTPs, 0.5 μM of each primer, and 1 μl per 50 μl of reaction of the polymerase (2.5 units). The reactions contained approximately 5-100 ng of template DNA per reaction. A 94° C. hot start for 2 minutes was used for PCRs, as well as a melting temperature of 94° C. The annealing temperature was dependent on the Tm of the primers, and was either 30 or 60 seconds. The extension time (at 72° C.) was at least 2 min per kb. The reaction products were normally separated on a 1×TAE 1% agarose gel, and bands of appropriate sizes were purified with QIAquick Gel Extraction Kit as recommend by the manufacturer except an elution volume of 10 to 50 µl was used. Volumes of 1 to 4 µl of the purified PCR product were used for ligation with the pCRII-Topo Blunt plasmid (Invitrogen, Carlsbad, Calif.) as recommended by the manufacturer.

Cloning of DATs in pET30a for Untagged Expression

The DATs having the sequence shown in SEQ ID NO:945, 947, 949, 891, 893, 869, 873, 877, 881, 883, and 895 (encoding the polypeptides having the sequence of SEQ ID NO:946, 948, 950, 892, 894, 870, 874, 878, 882, 884, and 896) were amplified from plasmids or PCR products with Pfu Turbo (Stratagene, La Jolla, Calif.) and primers adding a Nde I at the 5' end and either a Not I or BamH I restriction site at the 3' end. The PCR fragments were cloned into pCR-Blunt II-Topo (Invitrogen, Carlsbad, Calif.) as recommended by the manufacturer. The sequence was verified by sequencing (Agencourt, Beverly, Mass.) and inserts with the correct sequences were then released from the vector using the appropriate restriction enzymes and ligated into the Nde I and Not I (or BamH I) restriction sites of pET30a. See Table 2 for specific primers.

The DAT nucleic acid having the sequence of SEQ ID NO:155 (encoding the polypeptide having SEQ ID NO:156) was amplified with Pfu Turbo (Stratagene) and primers adding a Nde I and Hind III restriction site at the 5' and 3' end, respectively. The PCR fragments were digested using Nde I and Hind III restriction enzymes and ligated into the Nde I and Hind III restriction sites of pET30a. See Table 2 for specific primers. It should be noted that the polypeptide having the sequence of SEQ ID NO:156 appeared to contain the following leader sequence with a probability of 0.991 (as determined by SignalP, as discussed in Nielsen, 1997, *Protein Engineering*, 10:1-6): KNSPIIAAYRAATPGSAAA (SEQ ID NO:1084). The nucleic acid encoding this DAT polypeptide was cloned with the apparent leader sequence.

TABLE 2

Primers for amplification

| Amplifies SEQ ID NO | PCR primers | SEQ ID NO: |
|---|---|---|
| 945 | 5'-CCGCCCCATATGAACGCACTAGGATATTACAACGGAAAATGG-3' | 978 |
|  | 5'-GGCGGATCCTTATCCAAAGAATTCGGCACGAGCTGTC-3' | 979 |
| 947 | 5'-CCGCCCCATATGCGCGAAATTGTTTTTTTGAATGGG-3' | 980 |
|  | 5'-CGGATCCCTAAACCATCTCAAAAAACTTTTGCTGAATAAACCGTG-3' | 981 |
| 949 | 5'-CCGCCCCATATGTTGGATGAACGGATGGTGTTCATTAAC-3' | 982 |
|  | 5'-GGCGGATCCCTAGTCCACGGCATAGAGCCACTCGG-3' | 983 |
| 891 | 5'-GGCCGCATATGGACGCACTGGGATATTACAACGGAAAATG-3' | 984 |
|  | 5'-GGCCGCGGCCGCCTATGCCTTTCTCCACTCAGGCGTGTAGC-3' | 985 |
| 893 | 5'-GGCCGCATATGGACGCACTGGGATATTACAACGGAAAATG-3' | 986 |
|  | 5'-GGCCGCGGCCGCCTATACTGTGCTCCACTCAGGCGTGTAGCC-3' | 987 |
| 869 | 5'-CATATGTATTCATTATGGAATGATCAAATAGTGAAGG-3' | 988 |
|  | 5'-GCGGCCGCCTATTTATTCGTAAAAGGTGTTGGAATTTTCG-3' | 989 |
| 873 | 5'-CATATGAGCACCCCGCCGACCAATC-3' | 990 |
|  | 5'-GCGGCCGCCTAGGCCGCCTTCACTTCACGCTC-3' | 991 |
| 877 | 5'-CATATGAGCACCCCGCCAACCAATTC-3' | 992 |
|  | 5'-GCGGCCGCCTACGCGGCCTTCACTTCGCGC-3' | 993 |
| 881 | 5'-TCCAGGCATATGAGCACAGTATATTTAAATGGCC-3' | 994 |
|  | 5'-CCAGTAGCGGCCGCCTAACACTCAACACTATACTTATGC-3' | 995 |
| 883 | 5'-TCTAGGCATATGGTTTATCTGAACGGGCG-3' | 996 |
|  | 5'-ACTGTAGCGGCGGCCTATCCGAGGGACGCGTTGG-3' | 997 |
| 895 | 5'-CATATGAAAGAGCTGGGCTATTACAACGGAAAAATC-3' | 998 |
|  | 5'-GCGGCCGCCTATGACCTCCACCCCTGATTTCCAAAATAC-3' | 999 |
| 155 | 5'-CTAGGATTCCATATGAAGAATTCGCCGATCATC-3' | 1000 |
|  | 5'-CGAAGCTTCAACAGCGGCCGCTTAAAG-3' | 1001 |

Site-Directed Mutagenesis

Site-directed mutagenesis was performed using QuikChange Multi Site-Directed Mutagenesis Kit (Stratagene, La Jolla, Calif.) according to the manufacturer's instructions. To generate the SEQ ID NO:870 T242N mutant, the pET30a untagged construct described in Example 10 was used as the template. To generate SEQ ID NO:220 G240N and SEQ ID NO:220 T241N mutants, the pET30a construct with a C-terminal his tag described in Example 10 was used as the template. The mutagenic primers used are listed below in Table 3. All the desired mutations were confirmed by DNA sequencing.

TABLE 3

Primer sequences

| Mutant polypeptide designation (SEQ ID NO) | Sequence | SEQ ID NO: |
|---|---|---|
| 870 T242N | 5'-AATTATTTGTTTCATCAACAAATTCTGAAATTACGCCGGTTATTG-3' | 1002 |
| 220 G240N | 5'-CTTGTGTCCAGCAGCAACACACTCGGCCTTAG-3' | 1003 |
| 220 T241N | 5'-GTCCAGCAGCGGCAACCTCGGCCTTAGCGCC-3' | 1004 |

Cloning of DAT PCR Products in pET30a for the Expression as Untagged Protein

DAT nucleic acids having the sequences shown in SEQ ID NO:177, 179, 153, 165, 181, 217, 187, 189, 207, 219, 215, 195, 199, 197, 209, 201, 221, 235, 203, 237, 239, 223, 225, 227, 229, 231, 245, 213, 155, 169, 171, 167, 173, and 175 (encoding DAT polypeptides having the sequence shown in SEQ ID NO:178, 180, 154, 166, 182, 218, 188, 190, 208, 220, 216, 196, 200, 198, 210, 202, 222, 236, 204, 238, 240, 224, 226, 228, 230, 232, 246, 214, 156, 170, 172, 168, 174, and 176) were received as PCR products with Nde I and Not I compatible ends, as well as extraneous nucleotides to improve cutting efficiencies.

plasmid pSE420-cHis), and SEQ ID NO:870 T242N, SEQ ID NO:176 and SEQ ID NO:220 (untagged versions expressed from pET30) were re-amplified with Pfu Turbo (Stratagene) and primers that placed an XhoI site immediately upstream of the stop codons. PCR fragments were cloned into pCR-Blunt II-Topo (Invitrogen, Carlsbad, Calif.) as recommended by the manufacturer or directly cloned into the Nde I and Xho I restriction sites of pET30a The sequence was verified by sequencing (Agencourt, Beverly, Mass.) and an insert with the correct sequence was then released from the vector using Nde I and Xho I restriction enzymes and the insert was ligated into the Nde I and Xho I restriction sites of pET30a. See Table 4 for specific primers and plasmids names.

TABLE 4

Primer sequences

| Polypeptide designation (SEQ ID NO) | Sequence | SEQ ID NO |
|---|---|---|
| 870 and 870 T242N | 5'-CATATGTATTCATTATGGAATGATCAAATAGTGAAGG-3'<br>5'-CTCGAGTTTATTCGTAAAAGGTGTTGGAATTTTCGTTTC-3' | 1005<br>1006 |
| DAT4978 and DAT4978T243N | 5'-CATATGAGTTATAGCTTATGGAATGACCAAATTGTGAATG-3'<br>5'-CTCGAGTGCGCGAATACCTTTTGGGATTTTCGTATC-3' | 1007<br>1008 |
| 220 | 5'-CTAGGATCTCATATGGACGCACTGGGATATTAC-3'<br>5'-GCCTCGAGTACCCTGCTCCACTCAGG-3' | 1009<br>1010 |
| 176 | 5'-CTAGGATTCCATATGGACGCGCTTGGCTATTAC-3'<br>5'-GCCTCGAGTACCCTGCTCCACGCAG-3' | 1011<br>1012 |

The DAT PCR products contained an NdeI restriction enzyme site at the 5' end and a NotI site at the 3' end. The PCR fragments were first cloned into pCR4 TOPO or pCR-Blunt II-TOPO vector (Invitrogen). After the DNA sequences were verified by sequencing, the DAT genes were released from the TOPO plasmids by the digestion of NdeI and NotI and ligated into the pET30a vector which had been cut using the same restriction enzymes. DAT genes containing either an NdeI or NotI site internally were amplified using primers with compatible restriction enzyme sites and cloned into pET30a. For example, the DAT nucleic acid having the SEQ ID NO:155 (encoding the polypeptide having the sequence of SEQ ID NO:156) was reamplified from the original PCR product using NdeI and HindIII restriction sites for cloning into pET30a.

Cloning of DATs in pET30a for the Expression as the C-His-Tagged Fusion Protein

Nucleic acids encoding DAT 4978 and DAT 4978 T243N (described in Example 6), SEQ ID NO:870 (expressed from Cloning of CbDAT and CaDAT A *Clostridium beijerinckii* D-amino-transferase was PCR amplified using Pfu Turbo (Stratagene) and *C. beijerinckii* genomic DNA with PCR primers containing a 5' NdeI and a 3' NotI restriction site. Genomic DNA was extracted from *C. beijerinckii* (ATCC 51743) using the Purrgene genomic DNA purification kit (Gentra Systems, Minneapolis, Minn.) per the manufacturer's instructions.

The 824 bp PCR product was gel extracted using a Qiagen Gel Extraction Kit and TOPO cloned into pCR-Blunt II-Topo (Invitrogen). After verifying the sequence, the gene was ligated to Nde I/Not I cut pET28b and pET30a vectors using a Rapid Ligation kit (Roche).

The *C. acetobutylicum* DAT was amplified by PCR using genomic DNA (ATCC 824) and the Stratagene Optiprime PCR Kit with PCR primers containing a 5' NdeI and a 3' NotI restriction site. The successful PCR reaction was cloned into the pCR4 TOPO vector and TOPO clones were sequenced. A positive TOPO clone was digested with restriction enzymes NdeI and NotI and the DAT fragment ligated into pET30a vector digested with the same restriction enzymes.

TABLE 5

Primer sequences

| Designation | Sequence | SEQ ID NO: |
|---|---|---|
| CbDAT1 | 5'-GGTTCATATGGAGAATTTAGGTTATTA-3' | 1013 |
| | 5'-GGAAGCGGCCGCATATTCTACCTCCTATTCTG-3' | 1014 |
| CaDAT2 | 5'-GGTTCATATGAAAGATTTAGGATATTACAATGGAGAATAC-3' | 1015 |
| | 5'GGAAGCGGCCGCTTAATTTGTTTCTTCCAAAAATTCATTAAG-3' | 1016 |

In Vitro Synthesis of LsDAT

The *Lactobacillus salivarius* DAT was assembled using a revised method based on Stemmer et al., 1995, *Gene*, 164: 49-53. Briefly, 43 oligonucleotides (primarily 40 mers) were ordered from IDT based on the gene sequence and its complementary DNA sequence, with 20 basepair overlaps between the sense and antisense strands. See Table 6 for the primer list. The primers were diluted to 250 μM in water and 5 μL of each primer was mixed together in a microfuge tube. PCR was carried out as follows: per 100 μL reaction, 1.5 μL of the primer pool, 4 μL dNTPs, 1×XL PCR buffer, 1 mM magnesium acetate, 2 μL rTth polymerase (Roche, Indianapolis, Ind.), and 0.25 μL Pfu polymerase (Stratagene, La Jolla, Calif.) were added. A 3 minute hot start was done at 94° C., followed by 15 cycles of 94° C. for 30 seconds, 42° C. for 30 seconds, and 68° C. for 15 seconds. Ten more cycles were done with an extension time of 30 seconds (at 68° C.). Ten more cycles were performed with an extension time of 75 seconds. Lastly, a chain extension step was done for seven minutes at 68° C.

TABLE 6

Oligos used to synthesis LsDAT

| Designation | Sequence (5' → 3') | SEQ ID NO: |
|---|---|---|
| F1: | ATGAAGCAAG TTGGATACTA CAATGGTACT ATCGCTGATT | 1017 |
| F2: | TAAATGAACT TAAGGTGCCT GCTACTGATC GTGCACTTTA | 1018 |
| F3: | TTTTGGTGAT GGTTGCTACG ATGCAACTAC ATTTAAGAAC | 1019 |
| F4: | AATGTTGCAT TTGCCTTAGA AGATCATCTT GATCGTTTTT | 1020 |
| F5: | ATAATAGTTG TCGCCTACTA GAGATCGATT TCCCTTTAAA | 1021 |
| F6: | TCGCGATGAA CTTAAAGAAA AGCTTTACGC TGTTATTGAT | 1022 |
| F7: | GCTAACGAAG TTGATACTGG TATCCTTTAT TGGCAAACTT | 1023 |
| F8: | CACGTGGTTC TGGTTTACGT AACCATATTT TCCCAGAAGA | 1024 |
| F9: | TAGCCAACCT AATTTATTAA TTTTTACTGC TCCTTATGGT | 1025 |
| F10: | TTAGTTCCAT TTGATACTGA ATATAAACTT ATATCTCGCG | 1026 |
| F11: | AAGACACTCG CTTCTTACAT TGCAATATTA AAACTTTGAA | 1027 |
| F12: | TTTACTTCCA AACGTTATTG CAAGTCAAAA GGCTAATGAA | 1028 |
| F13: | AGTCATTGCC AAGAAGTGGT CTTCCATCGC GGTGACAGAG | 1029 |
| F14: | TTACAGAATG TGCACACTCT AACATCTTAA TTCTAAAAGA | 1030 |
| F15: | TGGCGTTCTT TGCTCCCCAC CTAGAGATAA TTTAATCTTG | 1031 |
| F16: | CCAGGAATTA CTTTGAAACA TCTCTTGCAA TTAGCAAAAG | 1032 |
| F17: | AAAATAATAT TCCTACTTCC GAAGCACCAT TCACTATGGA | 1033 |
| F18: | TGATCTTAGA AATGCTGATG AAGTTATTGT TAGTTCTTCA | 1034 |
| F19: | GCTTGTCTAG GTATTCGCGC AGTCGAGCTT GATGGTCAGC | 1035 |
| F20: | CTGTTGGTGG AAAAGATGGA AAGACTTTAA AGATCTTGCA | 1036 |
| F21: | AGATGCTTAT GCTAAGAAAT ATAATGCTGA AACTGTAAGT CGTTAA | 1037 |
| R1: | TAGTATCCAA CTTGCTTCAT | 1038 |
| R2: | AGGCACCTTA AGTTCATTTA AATCAGCGAT AGTACCATTG | 1039 |

TABLE 6-continued

Oligos used to synthesis LsDAT

| Designation | Sequence (5' → 3') | SEQ ID NO: |
|---|---|---|
| R3: | CGTAGCAACC ATCACCAAAA TAAAGTGCAC GATCAGTAGC | 1040 |
| R4: | TCTAAGGCAA ATGCAACATT GTTCTTAAAT GTAGTTGCAT | 1041 |
| R5: | TAGTAGGCGA CAACTATTAT AAAAACGATC AAGATGATCT | 1042 |
| R6: | TTTCTTTAAG TTCATCGCGA TTTAAAGGGA AATCGATCTC | 1043 |
| R7: | CCAGTATCAA CTTCGTTAGC ATCAATAACA GCGTAAAGCT | 1044 |
| R8: | ACGTAAACCA GAACCACGTG AAGTTTGCCA ATAAAGGATA | 1045 |
| R9: | TTAATAAATT AGGTTGGCTA TCTTCTGGGA AAATATGGTT | 1046 |
| R10: | TCAGTATCAA ATGGAACTAA ACCATAAGGA GCAGTAAAAA | 1047 |
| R11: | ATGTAAGAAG CGAGTGTCTT CGCGAGATAT AAGTTTATAT | 1048 |
| R12: | CAATAACGTT TGGAAGTAAA TTCAAAGTTT TAATATTGCA | 1049 |
| R13: | ACCACTTCTT GGCAATGACT TTCATTAGCC TTTTGACTTG | 1050 |
| R14: | AGAGTGTGCA CATTCTGTAA CTCTGTCACC GCGATGGAAG | 1051 |
| R15: | GTGGGGAGCA AAGAACGCCA TCTTTTAGAA TTAAGATGTT | 1052 |
| R16: | TGTTTCAAAG TAATTCCTGG CAAGATTAAA TTATCTCTAG | 1053 |
| R17: | GGAAGTAGGA ATATTATTTT CTTTTGCTAA TTGCAAGAGA | 1054 |
| R18: | CATCAGCATT TCTAAGATCA TCCATAGTGA ATGGTGCTTC | 1055 |
| R19: | GCGCGAATAC CTAGACAAGC TGAAGAACTA ACAATAACTT | 1056 |
| R20: | TCCATCTTTT CCACCAACAG GCTGACCATC AAGCTCGACT | 1057 |
| R21: | ATTTCTTAGC ATAAGCATCT TGCAAGATCT TTAAAGTCTT | 1058 |
| R22: | TTAACGACTT ACAGTTTCAG CATTAT | 1059 |

A secondary amplification with primers L. sal DAT R Not I and L. sal DAT F Nde I (below) resulted in a band of the correct molecular weight. See Table 7 for these secondary amplification primer sequences.

TABLE 7

Primer sequences

| Designation | Sequence (5' → 3') | SEQ ID NO: |
|---|---|---|
| L. sal DAT R NotI | TTGGCCAAGCGGCCGCTTAACGACTTACAGTTT | 1060 |
| L. sal DAT F NdeI | GGTTCCAAGGCATATGAAGCAAGTTGGATACTA | 1061 |

The secondary PCR reaction was set up the same as above with the exception that only 2 primers were added. For the PCR template, 2.5 μl of the primary PCR reaction was used. A 3 minute hot start was done at 94° C., followed by 10 cycles of 94° C. for 30 seconds, 42° C. for 30 seconds, and 68° C. for 15 seconds. Ten more cycles were done with an increased annealing temp of 48° C. for 30 seconds with an extension time of 30 seconds (at 68° C.). Lastly, a chain extension step was done for seven minutes at 68° C.

The fragment was cloned into a pCR-BluntII-TOPO vector and the TOPO clones were sequenced. A positive TOPO clone was cut with NdeI and NotI and the DAT fragment ligated into pET30a vector digested with the same restriction enzymes.

Enzyme Preparation

E. coli strain BL21(DE3) was used as the host strain for the expression of DATs from pET-derived plasmids. E. coli strain TOP10 was used in all other DAT constructs. Single colonies of desired constructs were typically inoculated into Overnight Express II medium (Novagen) containing the appropriate amount of antibiotics. Following cultivation at 30° C. overnight, the cells were harvested by centrifugation when the $OD_{600}$ was greater than 10. Alternatively, overnight cultures were utilized to innoculate cultures in LB medium containing the appropriate antibiotics. The cultures were grown at 30° C. to an $OD_{600}$ of 0.5 to 0.9 and protein expression was induced with 1 mM IPTG for 4 h at the same temperature.

Cell extracts were prepared by adding 5 mL per g of cell pellet or 5 mL per 50 mL of overnight culture, of BugBuster® (primary amine-free) Extraction Reagent (EMD Biosciences/Novagen catalog #70923) with 5 μL/mL of Protease Inhibitor Cocktail II (EMD Bioscience/Calbiochem catalog #539132), 1 μl/ml of Benzonase® Nuclease (EMD Biosciences/ Novagen catalog #70746), and 0.033 μl/ml of r-Lysozyme™ solution (EMD Biosciences/Novagen catalog #71110) to the cells. The cell resuspension was incubated at room temperature for 15 min with gentle shaking. Following centrifugation at 16,100 rcf for 20 min at 4° C., the supernatant was removed as the cell-free extract.

Prior to using the enzyme preparation for monatin reactions, detergents and low molecular weight compounds were removed from the cell-free extract by passage through a PD-10 column (GE Healthcare, Piscataway, N.J.) that was previously equilibrated with potassium phosphate buffer (100 mM, pH 7.8) or EPPS buffer (100 mM, pH 8.2) containing 0.05 mM of PLP. The protein was eluted using the equilibration buffer. Protein concentrations were typically determined using the BioRad Coomassie plate assay (also known as the Bradford assay) plate assay with BSA (Pierce) as the standard. Occasionally, the BCA (Pierce) microtiter plate assay was used for protein determination, where noted. To estimate the concentration of the D-aminotransferase in the cell-free extracts, 1 mg/mL samples were loaded on the Experion (Bio-Rad, Hercules, Calif.) electrophoresis system and the Experion Software (Version 2.0.132.0) was used to calculate the percentage of the soluble DAT protein in the cell-free extract. Alternatively, SDS-PAGE analysis was done and visual estimation was used to estimate percentage of expression.

The His-tagged fusion proteins were purified using either the GE Healthcare Chelating Sepharose Fast Flow resin or Novagen His-Bind columns. The purification using the Sepharose resin involved loading the cell-free extract onto a column that was previously equilibrated with potassium phosphate buffer (100 mM, pH 7.8) containing 200 mM of sodium chloride and 0.050 mM of PLP. The column was then washed successively using 3-5 column volumes of the equilibration buffer, 3-5 column volumes of the equilibration buffer containing 25 mM of imidazole and 3-5 column volumes of the equilibration buffer containing 50-100 mM of imidazole. The His-tagged protein was eluted off the column using 3-5 column volumes of the equilibration buffer containing 500 mM of imidazole. The eluate was concentrated using the Amicon (Billerica, Mass.) Centricon-70. The imidazole and sodium chloride salts in the concentrated protein solution were removed by passage through PD-10 desalting columns that were previously equilibrated using potassium phosphate buffer (100 mM, pH 7.8) (for DAT4978 and DAT4978 T243N) or EPPS buffer (100 mM, pH 8.2) (for SEQ ID NO:870 and SEQ ID NO:870 T242N) containing 50 μM of PLP. Protein concentrations were determined using Bio-Rad Protein Assay (Bio-Rad) and Albumin (Pierce) as a standard. Aliquots (0.5-1 mL) of the purified enzyme were stored at −80° C. until use. The purification of the His-tagged protein using the His-Bind columns followed the manufacture's instruction. The eluate from the column was desalted using the PD10 column as described above.

Example 5

Assay Procedures #2 for D-Aminotransferase Activity

Monatin Production Assay (Standard)

The following components were combined: 100 mM EPPS, pH 8.2; 200 mM sodium pyruvate; 100 mM of D-tryptophan; 50 μM PLP; 1 mM $MgCl_2$; 0.01% Tween-80; 50 μg/mL of aldolase described in Example 6 (cell-free extract was used; the aldolase concentration was estimated based on the percentage reading from Experion chip) and an appropriate amount of DAT (typically 0.1-1 mg/mL).

Except for the PLP stock solution and the protein solutions, all other reagents were made using oxygen-free deionized water and stored in the anaerobic chamber. The reactions were set up in the anaerobic chamber at room temperature with constant gentle mixing. To take a time point, formic acid was added into an aliquot of the reaction mixture to a final concentration of 2% (v/v). Following centrifugation at 16,100 RCF for 5 min using a bench-top microfuge, the supernatant was filtered through a 0.2 μm nylon membrane filter. Samples were then diluted 20- to 100-fold with water prior to analysis by LC/MS/MS.

D-Tryptophan Transamination Assay

To compare the D-tryptophan transamination activities of certain D-aminotransferases, the following assays were performed. The assay mix contained: 0.5 mg/mL of cellular extract protein containing D-AT; 40 mM potassium phosphate pH 8.0; 20 mM D-tryptophan; 100 mM sodium pyruvate; and 50 μM PLP. The assays were incubated at 37° C. for 30 minutes and then placed on ice.

The extent of reaction was followed by measuring the amount of indole-3-pyruvate formed using the following assay: to 5 μl, 10 μl and 20 μl of reaction mix, 200 μl of the following solution was added: 0.5 mM sodium arsenate; 0.5 mM EDTA; and 50 mM sodium tetraborate (pH 8.5). Absorbance of the indole-3-pyruvate enol-borate complex at 325 nm was compared to a standard curve of indole-3-pyruvate prepared in the same solution.

Alanine formation can also be used to follow the extent of the D-tryptophan transamination reactions. Alanine concentrations were determined as described in Example 3.

R,R Monatin Transamination Assay

Assay conditions (final volume 2 mL) included: 0.01% Tween; 100 mM EPPS pH 8.2; 100 mM sodium pyruvate; approximately 3 mM R,R monatin; 0.5 mg/mL DAT; and 50 μM PLP. The extent of reaction was monitored by detection of alanine or R-MP formed using the protocols described in Example 3.

Example 6

Method for Obtaining DATs and an Aldolase

This method described the cloning of the aldolase used in monatin formation reactions with the D-aminotransferases, and D-aminotransferases previously isolated that were used for comparative purposes.

Aldolase

The aldolase used in monatin production assays from D-tryptophan was isolated and subcloned into pET vectors as described in WO 2007/103389 (referred to in that application as the aldolase of SEQ ID NO:276 encoded by the nucleic acid of SEQ ID NO:275).

DAT and DAT4978 T243N

A D-aminotransferase from ATCC #4978 (DAT 4978) was cloned as described in U.S. Publication No. 2006/0252135. A T243N mutant was made using the pET30 (untagged) DAT 4978 construct.

The primer for mutagenesis was designed following the suggestions listed in the Stratagene Multi-Change kit (La Jolla, Calif.). The primer was 5'-phosphorylated. Mutagenesis was done using the Stratagene Multi-Change kit following the manufacturer's instructions. The mutagenic oligonucleotide sequence is shown in Table 8.

TABLE 8

Mutagenic oligonucleotide sequences

| Mutant name | Amino acid change | Primer | SEQ ID NO: |
|---|---|---|---|
| DAT4978T243N | T243N | 5'-GTGATTGTTTCATCAACGAATTCAGAAGTAACGCC-3' | 1062 |

E. coli XL10-Gold cells (Stratagene) were transformed and the resultant purified plasmid preparations were sequenced to verify that the correct mutations were incorporated. The plasmid containing the DAT 4978 T243N was then transformed into E. coli BL21 (DE3) expression host B. sphaericus DAT A D-aminotransferase from B. sphaericus (ATCC number 10208) was cloned as described in US 2006/0252135. The protein was prepared as described in the same reference.

Example 7

Analysis of DATs

DAT polypeptides having the sequence shown in SEQ ID NO:928, 930, 932, 934, 936, 938, 940, 942, 944, 946, 948, and 950 were produced by expressing the corresponding nucleic acid in the vectors and in the compatible E. coli expression hosts described in Example 2. One skilled in the art can synthesize the genes encoding these D-aminotransferases using assembly PCR techniques such as those described in Example 4. Overnight cultures in LB medium containing carbenicillin (100 μg/mL) were diluted 100× in 100 mL of the same medium and grown in a 500 mL baffled flask. The culture was grown at 30° C. to an $OD_{600}$ of 0.5 to 0.9, and protein expression was induced with 1 mM IPTG for 4 h at the same temperature. Samples for total protein were taken immediately prior to harvesting. Cells were harvested by centrifugation and washed once with 10 mL of potassium phosphate buffer pH 7.8. Cells were immediately frozen at −80° C. until cell extracts were prepared.

Cell extracts were prepared and desalted as described in Example 4 using 100 mM potassium phosphate as the buffer to elute and equilibrate the PD10 column. Total protein and DAT concentrations were determined as described.

Transamination of R,R monatin with pyruvate as the amino acceptor were performed as described in Example 5 except that 10 mM R,R monatin was utilized. Initial analyses of alanine, monatin, and monatin precursor levels were not consistent with each other and results were considered qualitative. The DAT polypeptide having the sequence of SEQ ID NO:948 appeared to show monatin precursor formation.

For further confirmation of activity, a monatin formation assay was done as described in the methods with a DAT concentration of approximately 0.2 mg/mL. As a control, 0.2 mg/mL concentration of purified B. sphaericus DAT was evaluated. After 2 and 21 hr, an aliquot was taken and formic acid was added to a final concentration of 2%, and the samples were frozen. Samples were then thawed, spun and filtered. Samples were analyzed for monatin using LC/MS/MS methodology and for tryptophan and alanine using the LC/OPA post-column fluorescence methodology described in Example 3. The DAT polypeptides having the sequence of SEQ ID NO:946 and 950 were capable of R,R monatin formation under the conditions tested. The DAT polypeptide having the sequence of SEQ ID NO:948 showed a loss of tryptophan and an increase in alanine formation, demonstrating its activity as a D-tryptophan transaminase. The DAT polypeptide having the sequence of SEQ ID NO:946 expressed well as determined by the amount of total protein but was not very soluble, which explains some inconsistent results. The DAT polypeptides having the sequence shown in SEQ ID NO:930, 932, 940, 942, and 944 did not yield visible bands on analysis with SDS-PAGE and, therefore, may be active if produced under different conditions. See Table 9 for results.

TABLE 9

Activity of DATs

| DAT Polypeptide (SEQ ID NO) | Monatin [mM] Time = 2 hr | Monatin [mM] Time = 21 hr |
|---|---|---|
| 928 | nd | nd |
| 930 | nd | nd |
| 932 | nd | nd |
| 934 | nd | nd |
| 936 | nd | nd |
| 938 | nd | nd |
| 940 | nd | nd |
| 942 | nd | nd |
| 944 | nd | nd |
| 946 | 0.1 | 0.6 |
| 948 | nd | nd |
| 950 | 0.4 | 3.1 |
| B. sphaericus control DAT | 0.8 | 4.4 | nd = not detected under conditions tested

Analysis of DAT Polypeptides in pET30a

The DAT polypeptides having the sequence of SEQ ID NO:946, 948, and 950 were subcloned into pET30a as described in Example 4. Duplicate cultures of E. coli strain BL21 DE3 containing the DATs in pET30a were grown overnight in Overnight Express II (Solution 1-6, Novagen) at both 25 and 30° C. As a control, a strain containing pET30a plasmid without an insert was also grown. Cells were collected at an $OD_{600}$ of 5-10. Cells were harvested by centrifugation and washed once with 10 mL of 100 mM potassium phosphate buffer pH 7.8. Cells were frozen at −80° C. until further processed.

Cell extracts were prepared as described in Example 4 using 100 mM potassium phosphate as the buffer to elute and equilibrate the PD10 columns. Total protein and DAT protein concentrations were determined as described. The DAT polypeptide having the sequence of SEQ ID NO:946 expressed well at 30° C. in the total protein fraction, but was not soluble as viewed by SDS-PAGE. The DAT polypeptides having the sequence of SEQ ID NO:948 and 950 expressed at the higher temperature also, but were soluble.

A monatin formation assay was done as described in Example 5 except with a DAT concentration of 0.1 mg/mL for the polypeptide of SEQ ID NO:946 (0.5 mg/mL for all others). As a positive control, purified B. sphaericus DAT at a 0.5 mg/mL concentration was also assayed. After 2 and 21 hr, an aliquot was taken, formic acid was added to a final concentration of 2%, and the samples were frozen until further processed. Samples were then thawed, spun and filtered. Samples were analyzed for monatin using LC/MS/MS, and for tryptophan and alanine using LC/OPA post-column fluorescence detection methods described in Example 3. The results are shown in Table 10. D-tryptophan consumption and alanine formation were shown for all the D-aminotransferases tested indicating that they all have activity on D-tryptophan. Under these conditions, only DAT polypeptides having the sequence of SEQ ID NO:946 and 948 appeared to have activity for monatin formation. It is possible that expression or stability differences between the two host systems are the reason why activity is seen in some cases but not in others.

TABLE 10

| DAT polypeptide (SEQ ID NO) | Monatin [mM] time = 2 hr | Monatin [mM] time = 21 hr |
|---|---|---|
| pET30 (negative control) | nd | nd |
| 946 | 0.4 | 1.8 |
| 948 | nd | 0.2 |
| 950 | nd | nd |
| *B. sphaericus* positive control | 1.8 | 8.6 | nd, not detected under conditions tested

Example 8

Analysis of DATs in pSE420-cHis

DAT polypeptides having the sequence shown in SEQ ID NOs:886, 888, 890, 892 and 894 DATs were produced from the pSE420-cHis vector in *E. coli* HMS174. One skilled in the art can synthesize the genes encoding these D-aminotransferases using assembly PCR techniques such as those described in Example 4. Overnight cultures of the various DAT constructs were grown in LB medium containing ampicillin (100 μg/mL) at 30° C. Fifty mL of the same medium was inoculated the next day with 1 mL of the overnight cultures. The cultures were grown at 30° C. until the $OD_{600\,nm}$ reached approximately 0.5 and then induced with 1 mM IPTG. The cultures were further incubated for 4 h at 30° C. and then harvested by centrifugation at 3800 rcf for 15 min. The cells were washed with 1.5 mL of 50 mM potassium phosphate, pH 7.0 and centrifuged again. The supernatant was decanted and the cell pellets were weighed.

Cell extracts were prepared as described in the methods using 100 mM potassium phosphate as the buffer to elute and equilibrate the column. Total and DAT concentrations were determined as described except BCA (Pierce) was used instead of Bradford for total protein determination. Two different vector only cultures were grown in the same *E. coli* hosts as the cloned DATs. All of the proteins produced visible bands on SDS-PAGE gels, but to differing degrees of solubility. Polypeptides having the sequence of SEQ ID NO:892 were not very soluble.

To compare the D-tryptophan transamination activities of each of the enzymes, the D-tryptophan transamination assay and the R,R monatin transamination assay described in Example 5 were performed. The D-tryptophan aminotransferase targeted using a final concentration of 0.5 mg/mL of cellular extract containing D-aminotransferase and 0.1 mg/mL of the purified *B. sphaericus* DAT as a control. Quantification of the DATs in the cellular extracts was difficult due to the low levels of soluble polypeptides. The DAT polypeptides having the sequence shown in SEQ ID NO:888, 892 and 894 showed good activity with D-tryptophan as a substrate during the 30 minute reaction. DAT polypeptides having the sequence shown in SEQ ID NO:886 and 890 had measurable activity above the no-enzyme control, but exhibited little activity under the conditions tested.

Monatin transamination experiments were performed at room temperature, taking samples after 0.5, 1 and 2 hours targeting 0.5 mg/mL of each DAT, including the purified positive control from *B. sphaericus*. The R,R monatin transamination samples were then analyzed for monatin and alanine. The amount of monatin remaining was quantified by LC/MS/MS; alanine formation was measured using the post-column derivatization method in Example 3. Under the conditions tested, the DAT polypeptides having the sequence shown in SEQ ID NOs:892 and 894 were active. The DAT polypeptide having the sequence of SEQ ID NO:894 appeared to have the highest activity for conversion of R,R monatin to R-MP. The trends were consistent when alanine formation was assayed. The alanine production numbers (in mM) for the various timepoints are shown in Table 11.

TABLE 11

Alanine formation (mM) from R,R monatin transamination reactions

| DAT polypeptide (SEQ ID NO) | 0.5 hr | 1 hr | 2 hr |
|---|---|---|---|
| vector control 1 | 0.139 | 0.185 | 0.215 |
| vector control 2 | 0.179 | 0.242 | 0.301 |
| 886 | 0.128 | 0.203 | 0.242 |
| 888 | 0.13 | 0.203 | 0.275 |
| 890 | 0.112 | 0.153 | 0.176 |
| 892 | 1.034 | 1.587 | 2.167 |
| 894 | 2.2 | 2.52 | 2.663 |
| BsphDAT(purified) | 0.287 | 0.519 | 0.894 |
| no enzyme | 0.043 | 0.035 | 0.037 |

DAT nucleic acids having the sequence shown in SEQ ID NO:891 and 893 were subcloned into pET30 as described in Example 4. These constructs were transformed into a variety of *E. coli* hosts carrying the DE3 lysogen for expression from a T7 promoter, including both K-12 and B strains of *E. coli*, and one strain that carried the pLysS plasmid. The clones were expressed in OvernightExpress System II as described in Example 4, with and without the addition of 0.5 mM pyridoxine, and analyzed by SDS-PAGE or Experion for expression. From these experiments, it became apparent that the proteins were expressing mostly in the insoluble fraction. Pyridoxine helped improve solubility to a small degree as did lowering the temperature from 37 to 30° C. for induction. Further work was done in cloning systems designed to maximize soluble expression (see Example 16-22).

Example 9

Analysis of CaDAT, CbDAT, and LsDAT in pET30a

The amino acid sequence shown in SEQ ID NO:894 was used to search for similar proteins available in the public databases. Three DATs were found that had similarity to SEQ ID NO:894. They were from *Lactobacillus salivarus* (47% identical at the protein level), *Clostridium beijerinckii* (57% identical at the protein level), and *Clostridium acetobutylicum* (60% identical at the protein level). The gene and protein sequences and their accession numbers are shown at the end of this example. FIG. 1 is an alignment showing the consensus regions of these SEQ ID NO:894-like proteins. One can see a high degree of consensus regions indicating structural similarities.

These nucleic acids were cloned into pET30a, and the corresponding polypeptides expressed and tested for activity as described herein.

CbDAT

The D-aminotransferase from *Clostridium beijerinckii* (CbDAT) was cloned into pET30a (untagged) BL21 (DE3) and expressed using Overnight Express II (Novagen). The cells were collected at an optical density at 600 nm of approximately 9 and centrifuged at 4000 rcf for 15 min. The cells were washed once with 100 mM potassium phosphate pH 7.8 (cold), and spun again.

Cell extracts were prepared as described herein using 100 mM EPPS pH 8.2 as the buffer to elute and equilibrate the column. Total protein and DAT protein concentrations were determined as described except the BCA method (Pierce) was used instead of the Bradford (Coomassie) assay. The CbDAT expressed well but was only partially soluble.

A monatin formation assay was done as described in Example 5 but the activity of CbDAT (0.5 mg/mL) was also studied at pH 7.4 (with potassium phosphate as a buffer). As a control, purified *B. sphaericus* DAT (1 mg/mL) was assayed at pH 8.2. After 1, 2, 4, 8, and 23 hrs, aliquots were taken and formic acid was added to a final concentration of 2%. Samples were frozen at −80° C. until analyzed. Samples were then thawed, spun and filtered. Samples were analyzed for monatin using the LC/MS/MS methodology described in Example 3. Results are shown in Table 12. The amount of monatin produced were slightly higher for the assays carried out at pH 8.2. Similar experiments were performed with the polypeptides expressed from pET28 with an N-terminal His-tag. The activity of the tagged version appeared to be slightly less than that of the untagged, but still easily detectable.

TABLE 12

| | Activity over time | | | | |
|---|---|---|---|---|---|
| DAT Enzyme | Monatin (ppm) 1 hr | Monatin (ppm) 2 hr | Monatin (ppm) 4 hr | Monatin (ppm) 8 hr | Monatin (ppm) 23 hr |
| CbDAT pET30 (7.4 mg/mL) | 45 | 126 | 280 | 428 | 502 |

TABLE 12-continued

| | Activity over time | | | | |
|---|---|---|---|---|---|
| DAT Enzyme | Monatin (ppm) 1 hr | Monatin (ppm) 2 hr | Monatin (ppm) 4 hr | Monatin (ppm) 8 hr | Monatin (ppm) 23 hr |
| CbDAT pET30 (8.2 mg/mL) | 67 | 189 | 344 | 436 | 568 |
| *B. sphaericus* DAT (1 mg/mL) | 531 | 968 | 1742 | 2310 | 3706 |

CaDAT and LsDAT

The D-aminotransferases from *Lactobacillus salivarus* (LsDAT) and *Clostridium acetobutylicum* (CaDAT) were cloned into pET30a (untagged) BL21(DE3) and expressed using Overnight Express II (Novagen). The cells were collected when the culture reached an optical density at 600 nm of approximately 9 by centrifugation at 4000 rcf for 15 minutes.

Cell extracts were prepared as described herein using 100 mM EPPS pH 8.2 as the buffer to elute and equilibrate the column. Total protein and DAT protein concentrations were determined using the BCA (Pierce) protocol. Both enzymes expressed well and were soluble.

The assay was performed at room temperature under anaerobic conditions. As a control, purified *B. sphaericus* D-aminotransferase was assayed. Approximately 0.5 mg/mL of each DAT was used. After 0.5, 1, 2, 4, 6, 8 and 22 hr an aliquot was taken and formic acid added to a final concentration of 2% and the samples were frozen. Samples were then thawed, spun and filtered. Samples were analyzed for monatin using the LC/MS/MS methodology described in Example 3. Results are shown in Table 13.

TABLE 13

| DAT polypeptide | Monatin (ppm) 0.5 hr | Monatin (ppm) 1 hr | Monatin (ppm) 2 hr | Monatin (ppm) 4 hr | Monatin (ppm) 6 hr | Monatin (ppm) 8 hr | Monatin (ppm) 22 hr |
|---|---|---|---|---|---|---|---|
| *B. sphaericus* | 76.6 | 194.4 | 457.6 | 860.8 | 1186 | 1770 | 2546 |
| LsDAT | 2.8 | 6.4 | 14.6 | 33 | 52 | 69.8 | 173 |
| CaDAT | 50.2 | 141.2 | 318.6 | 543.4 | 612 | 1144 | 668 |

The homologs of the DAT having the sequence shown in SEQ ID NO:894 were active. Since the homologs showing the conserved sequence above were all active in monatin formation assays, it is expected that any D-aminotransferase containing the consensus sequences described herein would also be active, although their primary sequence identity is as low as 47%. There has been no evidence before this work that these unique D-aminotransferases, with low homology to the more characterized *Bacillus* D-aminotransferase, would have activity for monatin or would be broad specificity enzymes.

```
DNA Sequence CaDAT (ACCESSION AE001437 AE007513-AE007868; VERSION
AE001437.1 GI: 25168256; nucleotides 914049 . . . 914891)
                                                       (SEQ ID NO: 1063)
    1 atgaaagatt taggatatta caatggagaa tacgacttaa ttgaaaatat gaaaatacca 61 atgaatgatc gtgtatgcta tttttggtgat ggtgtttatg atgctactta tagtagaaac 121 cataatatat ttgcactaga tgagcatatt gaccgatttt ataatagtgc cgagcttta
```

-continued

```
181 agaattaaaa ttccatatac aaagaaggaa atgaaagagc ttttaaagga tatggttaaa 241 aaggttgata gcggagaaca atttgtatat tggcaggtta ctagaggtac tggcatgcgt 301 aatcatgctt ttttgagtga ggatgttaag gctaatattt ggattgtttt aaagccacta 361 aaggtaaaag atatgtcaaa aaaattaaaa ctaataacat tagaggatac tagattttta 421 cattgtaaca taaaaacctt aaatttgctt cctagtgtaa ttgcagcaca aaaaactgaa 481 gaagcaggct gccaggaagc agtatttcat agaggagata gagttactga atgtgctcat 541 agtaatgttt caattataaa ggatgagatt ttaaaaactg cgccaacaga taatcttatt 601 ttgccgggaa tagcaagggc gcatcttata aaaatgtgca aaaaatttga gatacctgta 661 gatgaaactc catttacatt aaaggagtta ttaatgcgg atgaagttat agttacaagt 721 tcagggcaat tttgtatgac tgcttgtgag atagatggaa gacctgtagg cggaaaagcg 781 ccagatatta ttaaaaagct tcagactgcc ttacttaatg aattttttgga agaaacaaat 841 taa
```

Protein Sequence CaDAT (ACCESSION NP_347428; VERSION NP_347428.1 GI: 15894079)

(SEQ ID NO: 1064)

```
  1 MKDLGYYNGE YDLIENMKIP MNDRVCYFGD GVYDATYSRN HNIFALDEHI DRFYNSAELL

61 RIKIPYTKKE MKELLKDMVK KVDSGEQFVY WQVTRGTGMR NHAFLSEDVK ANIWIVLKPL

121 KVKDMSKKLK LITLEDTRFL HCNIKTLNLL PSVIAAQKTE EAGCQEAVFH RGDRVTECAH

181 SNVSIIKDEI LKTAPTDNLI LPGIARAHLI KMCKKFEIPV DETPFTLKEL INADEVIVTS

241 SGQFCMTACE IDGRPVGGKA PDIIKKLQTA LLNEFLEETN
```

DNA Sequence CbDAT (ACCESSION CP000721 AAL001000000 AAL001000001-AAL001000089 VERSION CP000721.1 GI: 149901357; nucleotides 3213484 . . . 3212636)

(SEQ ID NO: 1065)

```
  1 atggagaatt taggttatta taatggaaag tttggattat tagaggaaat gacagtacca 61 atgcttgatc gtgtttgcta ttttggagat ggagtttatg atgctactta tagcagaaat 121 cacaagattt ttgcattgga ggagcatatt gaaagatttt acaacagcgc tggtttatta 181 ggaattaaaa ttccttattc aaaggagcaa gtaaagaaa tccttaagga gatggtatta 241 aaggttgatt caggagaaca atttgtatat tggcaaatta ctagaggaac tggaatgaga 301 aatcatgctt ttcctggaga tgaggtccct gcaaatctat ggattatgtt aaagccttta 361 aatattaagg atatgtcaca aaaattaaag ttaatcactt tagaagacac tagattttta 421 cactgtaata tcaaaacctt aaatttatta ccaagtgtaa ttgcatctca aaaaactgaa 481 gaggcaggat gtcaggaagc tgtatttcat agaggggata gagtaactga atgtgcacat 541 agcaatgtat caattattaa ggatggtata ttaaaaactg ctccaacaga caatttaatt 601 ttaccaggta tagcaagagc tcaccttatt aaaatgtgta atcctttaa tattcctgta 661 gatgaaacag catttacctt gaaggaatta atggaggcag atgaagttat agttactagt 721 tcaggtcaat tttgtatggc aaccagtgaa atagatggaa tacctgtagg gggaaaagca 781 ccagagcttg taagaaatt acaagatgca ttgttaaatg agttcttaga agaaacaaaa 841 acagaatag
```

Protein Sequence CbDAT (ACCESSION YP_001309869 VERSION YP_001309869.1 GI: 150017615)

(SEQ ID NO: 1066)

```
  1 MENLGYYNGK FGLLEEMTVP MLDRVCYFGD GVYDATYSRN HKIFALEEHI ERFYNSAGLL

61 GIKIPYSKEQ VKEILKEMVL KVDSGEQFVY WQITRGTGMR NHAFPGDEVP ANLWIMLKPL
```

-continued

```
121 NIKDMSQKLK LITLEDTRFL HCNIKTLNLL PSVIASQKTE EAGCQEAVFH RGDRVTECAH

181 SNVSIIKDGI LKTAPTDNLI LPGIARAHLI KMCKSFNIPV DETAFTLKEL MEADEVIVTS

241 SGQFCMATSE IDGIPVGGKA PELVKKLQDA LLNEFLEETK TE
```

DNA Sequence LsDAT (ACCESSION CP000233 VERSION CP000233.1 GI: 90820184; nucleotides 1750082 . . . 1750927)

(SEQ ID NO: 1067)

```
  1 atgaagcaag ttggatacta caatggtact atcgctgatt taaatgaact taaggtgcct 61 gctactgatc gtgcactta ttttggtgat ggttgctacg atgcaactac atttaagaac 121 aatgttgcat ttgccttaga agatcatctt gatcgttttt ataatagttg tcgcctacta 181 gagatcgatt tccctttaaa tcgcgatgaa cttaaagaaa agctttacgc tgttattgat 241 gctaacgaag ttgatactgg tatcctttat tggcaaactt cacgtggttc tggtttacgt 301 aaccatattt tcccagaaga tagccaacct aatttattaa tttttactgc tccttatggt 361 ttagttccat ttgatactga atataaactt atatctcgcg aagacactcg cttcttacat 421 tgcaatatta aactttgaa tttacttcca aacgttattg caagtcaaaa ggctaatgaa 481 agtcattgcc aagaagtggt cttccatcgc ggtgacagag ttacagaatg tgcacactct 541 aacatcttaa ttctaaaaga tggcgttctt tgctccccac ctagagataa tttaatcttg 601 ccaggaatta ctttgaaaca tctcttgcaa ttagcaaaag aaaataatat tcctacttcc 661 gaagcaccat tcactatgga tgatcttaga aatgctgatg aagttattgt tagttcttca 721 gcttgtctag gtattcgcgc agtcgagctt gatggtcagc ctgttggtgg aaaagatgga 781 aagactttaa agatcttgca agatgcttat gctaagaaat ataatgctga aactgtaagt 841 cgttaa
```

Protein Sequence LsDAT (ACCESSION YP_536555 VERSION YP_536555.1 GI: 90962639)

(SEQ ID NO: 1068)

```
  1 MKQVGYYNGT IADLNELKVP ATDRALYFGD GCYDATTFKN NVAFALEDHL DRFYNSCRLL

61 EIDFPLNRDE LKEKLYAVID ANEVDTGILY WQTSRGSGLR NHIFPEDSQP NLLIFTAPYG

121 LVPFDTEYKL ISREDTRFLH CNIKTLNLLP NVIASQKANE SHCQEVVFHR GDRVTECAHS

181 NILILKDGVL CSPPRDNLIL PGITLKHLLQ LAKENNIPTS EAPFTMDDLR NADEVIVSSS

241 ACLGIRAVEL DGQPVGGKDG KTLKILQDAY AKKYNAETVS R
```

Example 10

Analysis of DATs

HMS174 E. coli containing the DAT nucleic acids having the sequence of SEQ ID NO:865, 867, 869, 871, 873, 875, and 877 in vector pSE420-cHis were obtained and streaked on agar plates containing LB medium with ampicillin. One skilled in the art can synthesize the genes encoding these D-aminotransferases using assembly PCR techniques such as those described in Example 4. Single colonies were used to inoculate 3 mL of LB medium containing ampicillin (100 μg/mL). Five hundred μl of the overnight culture was used to inoculate 50 mL of the same medium in 250 mL baffled flasks. The cells were grown at 30° C. to approximately an OD$_{600nm}$ of 0.5. IPTG was added to a final concentration of 1 mM. Cells were induced at 30° C. for 4 hours and collected by centrifugation.

Cell extracts were prepared as described in Example 4. Total protein and DAT concentrations were determined as described in Example 4. The DATs all appeared to express well, and most of them showed a high degree of solubility.

A monatin formation assay was done as described in Example 5 except with a DAT concentration of 0.1 mg/mL and the aldolase at a concentration of 10 μg/mL. As a control, 0.1 mg/mL of purified B. sphaericus DAT was assayed. After 6 and 22 hours, an aliquot was taken and formic acid added to a final concentration of 2%, and the samples were frozen. Samples were then thawed, spun and filtered. Samples were analyzed for monatin concentrations using the LC/MS/MS methodology described in Example 3. Under the conditions tested, SEQ ID NO:870, 874 and 878 all appeared to have high activity in the 3-step monatin formation assay. DAT polypeptides having the sequences shown in SEQ ID NOs: 866, 872, and 876 also had activity in the monatin formation pathway but not to the same extent as did polypeptides having the sequence shown in SEQ ID NOs:870, 874 and 878 under the conditions tested. Table 14 shows the results for monatin formation (in ppm).

TABLE 14

| Monatin formation assay | | |
|---|---|---|
| DAT polypeptide (SEQ ID NO) | 6 hr | 22 hr |
| 866 | 17.4 | 76 |
| 868 | nd | nd |
| 870 | 132 | 836 |

TABLE 14-continued

Monatin formation assay

| DAT polypeptide (SEQ ID NO) | 6 hr | 22 hr |
|---|---|---|
| 872 |  | 13.8 | 50 |
| 874 | 281.6 | 798 |
| 876 | 2.4 | 12 |
| 878 | 223.4 | 576 |
| B. sphaericus DAT | 175.6 | 616 | nd, not detected under conditions tested

Further Analysis of Polypeptides Having the Sequence of SEQ ID NO:870, 874 and 878 in pET30a Cultures of E. coli BL21 DE3 transformed with pET30a plasmids containing nucleic acids encoding the above-indicated DATs were grown overnight in 50 mL of Overnight Express II (Solution 1-6, Novagen) at 30° C. As a positive control, a strain containing the DAT from ATCC #4978 in pET30a was also grown and induced (described in Example 6). Cells were collected at an $OD_{600nm}$ of 5-10, harvested by centrifugation and frozen at −80° C. until further processed.

Cell extracts were prepared as described in the Example 4. Total protein and DAT concentrations were determined as described in Example 4.

A monatin formation assay was done as described in Example 5 except with a DAT polypeptide concentration of 0.5 mg/mL for SEQ ID NO:870 and a concentration of 0.275 mg/mL for each of SEQ ID NO:874 and 878. As a control, DAT4978 and purified B. sphaericus DAT were assayed at 0.5 mg/mL concentration. After 0.5, 1, 2, 4, 6.5, 9, 24 and 22 hr, an aliquot was taken and formic acid added to a final concentration of 2% and the samples were frozen. Samples were then thawed, spun and filtered. Samples were analyzed for monatin using the LC/MS/MS methodology described in Example 3. The results are shown in Table 15 (in ppm of monatin formed).

TABLE 15

| DAT polypeptide (SEQ ID NO) | 0.5 hr | 1 hr | 2 hr | 4 hr | 6.5 hr | 9 hr | 24 hr |
|---|---|---|---|---|---|---|---|
| 4978 DAT | 18 | 85.6 | 283.4 | 673.2 | 890 | 1226 | 2020 |
| 870 | 14.4 | 71 | 279.4 | 736 | 1340 | 1680 | 3362 |
| 874 | 63.8 | 182.6 | 415.6 | 674 | 888 | 938 | 1154 |
| 878 | 97.8 | 244.4 | 607 | 912.2 | 1068 | 1174 | 1356 |
| B. sphaericus | 44.6 | 142.8 | 375.2 | 813 | 1294 | 1382 | 2746 |

All three of the subcloned DATs (encoding polypeptides having the sequence of SEQ ID NO:870, 874, and 878) expressed well in the pET system and yielded soluble protein. The polypeptide having the sequence shown in SEQ ID NO:870 gave the highest amount of expression in the soluble fraction and exhibited high activity that did not appear to diminish over time in comparison to the DAT polypeptides having the sequence of SEQ ID NO:874 and 878.

Comparison Between Wild Type and Mutant DAT Polypeptides

A mutant polypeptide in which the residue of SEQ ID NO:870 was changed from a T to a N (SEQ ID NO:870 T242N) was constructed as described in Example 4 and expressed and compared to DAT4978, DAT4978 T243N (described in Example 6), B. sphaericus and wildtype SEQ ID NO:870.

Cultures of BL21 DE3 in which the wild type and mutant polypeptides having the sequence of SEQ ID NO:870, 870 T242N, DAT4978 and DAT4978 T243N were expressed from the pET30a vector, were grown in 50 mL of Overnight Express (Novagen) in a 250 mL baffled flask overnight at 30° C. and 250 rpm. The cells were collected by centrifugation when they reached an optical density at 600 nm of over 10. Cell extracts were prepared as described in Example 4, and total protein and DAT concentrations were determined as described in Example 4. All of the DATs tested were highly expressed and soluble, all near 30% as determined using the Experion software. The polypeptide having the sequence of SEQ ID NO:870 T242N had the highest expression, which was predicted to be 36.3% of the total soluble protein.

A monatin formation assay was done as described in Example 5 at a DAT polypeptide concentration of 0.5 mg/mL. As a control, 0.5 mg/mL of purified B. sphaericus DAT was assayed. After 0.5, 1 2, 4, 6.5, 9 and 23.25 hr, an aliquot was taken, formic acid added to the aliquot to a final concentration of 2% and the samples frozen. Samples were then thawed, spun and filtered. Samples were analyzed for monatin, tryptophan, alanine and 4-hydroxy-4-methyl glutamic acid (HMG) as described in Example 3.

In the last time point, an additional aliquot was taken to determine % R,R monatin by the FDAA-derivatization method described in Example 3.

Monatin formation numbers (ppm) are presented in Table 16 below. The percent R,R is given in the right-hand column, for the 23.25 hr timepoint.

TABLE 16

| DAT polypeptide(SEQ ID NO) | 0.5 hr | 1 hr | 2 hr | 4 hr | 6.5 hr | 9 hr | 23.25 hr | % R,R |
|---|---|---|---|---|---|---|---|---|
| Wild type DAT 4978 | 11 | 57 | 216 | 472 | 694 | 942 | 1616 | 95.0 |
| 4978 T243N | 74 | 237 | 542.6 | 1106 | 1396 | 1784 | 2202 | 99.0 |
| 870 | 15.6 | 74.4 | 269.6 | 702 | 1250 | 1522 | 2788 | 97.8 |
| 870 T242N | 49.4 | 194 | 655.2 | 1496 | 2212 | 2666 | 3670 | 99.5 |
| B. sphaericus | 40.6 | 144 | 372 | 800 | 1090 | 1458 | 2434 | 97.2 |

The activity of the T242N mutant of the SEQ ID NO:870 polypeptide was very high, and was better than the positive controls and higher than the wildtype form of DAT polypeptides. The percentage of R,R monatin formed by this mutant was also higher than any of the other benchmark enzymes. The analysis of the amount of HMG (a by-product) formed is qualitative, but it appears that, at the 9 hour and 23.25 hour timepoints, similar amounts of HMG were formed by DAT 4978 T243N polypeptides and SEQ ID NO:870 T242N polypeptides.

Figure 2:
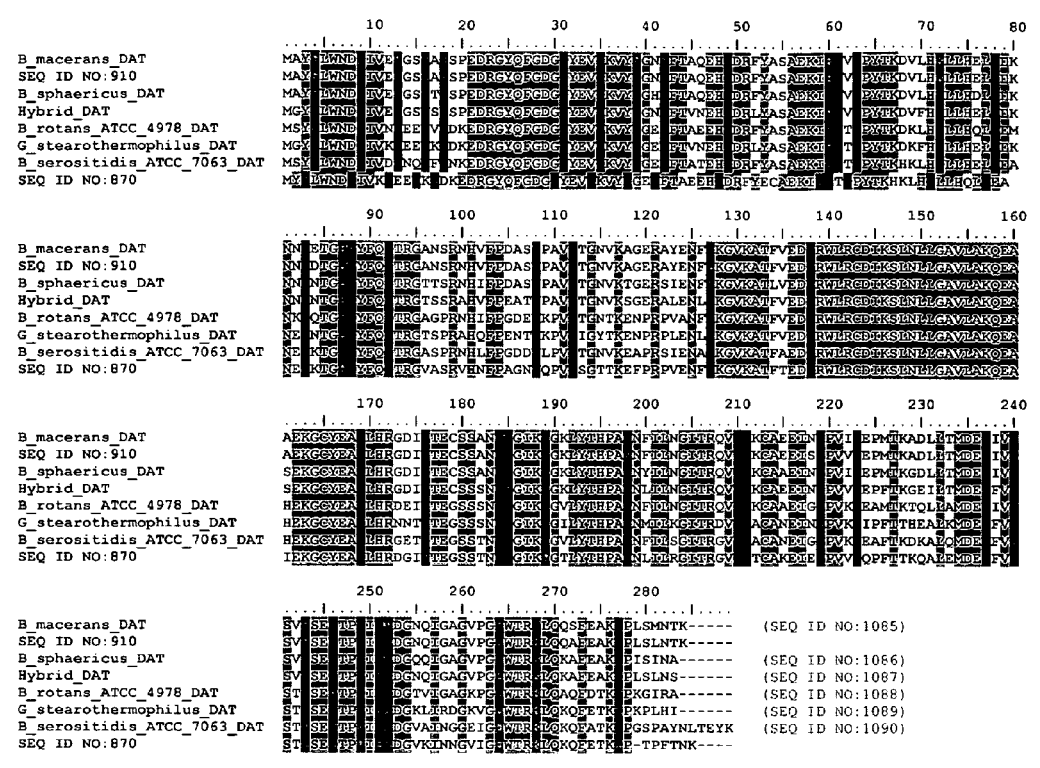

The DAT polypeptide having the sequence shown in SEQ ID NO:870 is a novel protein, exhibiting 76% sequence identity to the closest known D-aminotransferase (Bacillus YM-1 D-aminotransferase) and 69% amino acid sequence identity to the B. sphaericus DAT described in Example 6. FIG. 2 shows an alignment of this novel enzyme with other published DATS, and one can see the residues that make this enzyme unique and may account for its superior activity.

The highly active DAT polypeptide having the sequence shown in SEQ ID NO:910 (more similar to B. sphaericus type DATs; see Example 12) is also shown in the alignment. As an example of the uniqueness of the SEQ ID NO:870 polypeptide, in the region surrounding amino acid residue 54-55 (*B. sphaericus* numbering) in the alignment of FIG. 2, it is clear that the *Bacillus*-like DATs have a high degree of conservation whereas SEQ ID NO:870 has the residues EC rather than AS. As another example, in the highly conserved region surrounding residue 135 of the alignment shown in FIG. 2, the SEQ ID NO:870 polypeptide has a more hydrophilic residue (T) versus predominantly valine residues. The core sequence that represents the SEQ ID NO:870 enzyme, but excludes previously known broad specificity D-aminotransferases and highly related homologs, is shown as Consensus Sequences A and B. It is expected that any polypeptide containing one of these consensus sequences would exhibit DAT activity and be active in monatin formation pathway steps.

```
Consensus Sequence A
                                                  (SEQ ID NO: 1069)
Y.*LWND.*IV.*EDRGYQFGDG.*YEV.*KVY.*G.*FT.*EH.*DR.*YECAEKI.*PYTK.*H.*L

LH.*L.*E.*N.*TG.*YFQ.*TRGVA.*RVHNFPAGN.*Q.*V.*SGT.*K.*F.*R.*N.*KGVKAT.*

TED.*RWLRCDIKSLNLLGAVLAKQEAIEKGCYEA.*LHR.*G.*TE.*SS.*N.*GIK.*GTLYT

HPA.*N.*ILRGITR.*V.*TCAKEIE.*PV.*Q.*T.*K.*LEMDE.*V.*S.*SE.*TP.*I.*DG.*KI.*N

G.*G.*WTR.*LQ.*F.*K.*P.

Consensus Sequence B
                                                  (SEQ ID NO: 1070)
Y[ST]LWND[QK]IV.[DE].{2}[VI].[IV].{2}EDRGYQFGDG[IV]YEV[IV]KVY[ND]G.[ML]F

T.{2}EH[IV]DR.YECAEKI[RK][LIV].[IV]PYTK.{3}H[QK]LLH.L[VI]E.N.[LV].TG[HN][IVL]

YFQ[IV]TRGVA.RVHNFPAGN[VI]Q.V[LI]SGT.K.F.R.{3}N.[EQ]KGVKAT.TED[IV]RWL

RCDIKSLNLLGAVLAKQEAIEKGCYEA[IV]LHR.G.[VI]TE.SS.N[VI][FY]GIK[DN]GTLYT

HPA[ND]N.ILRGITR.V[IV][LI]TCAKEIE[LMI]PV.[EQ]Q.{2}T.K.{2}LEMDE[LIVM].V[ST]

S.[TS]SE[IV]TP[VI]I[DE][IVL]DG.KI.NG.{2}G[ED]WTR[KQ]LQ.{2}F.{2}K[IL]P..
```

Similar to PERL regular expression convention language, ".*" indicates that any number of amino acid residues may be present from any of the 20 proteinogenic amino acids; [ ] indicates that any one of the amino acids in the brackets can be present; ".{#}" indicates that any of the 20 proteinogenic amino acids can be present as long as the number of residues matches the number {#} indicated in the brackets.

With respect to the use of ".*" in Consensus sequence A, the number of amino acids at any of the ".*" positions can vary, for example, from 0 to about 20 residues (see, for example, Consensus sequence B (SEQ ID NO:1070)) or from about 20 residues up to about 100 residues, or the number of amino acids can be much larger, for example, up to 1000 or more residues. Without limitation, an insertion at one or more of the ".*" positions can correspond to, for example, a domain such as (but not limited to) a chitinase binding domain (e.g., from *Pyrococcus furiosus* (Accession No. 2CZN_A) or *P. burkholderia* (Accession No. YP_331531) or a cellulose binding domain (e.g., from *Cellulomonas fimi* (Accession No. 1 EXH_A) or *Clostridium stercorarium* (Accession No. 1UY1_A). In some embodiments (without limitation), five or less of the positions designated ".*" each contain an insertion of, for example, greater than about 20 residues (e.g., greater than about 100 residues). In other embodiments (without limitation), five or more of the positions designated ".*" each contains an insertion of less than about 100 residues (e.g., less than about 20 residues, e.g., 3, 5, 10, 20, 25, 30, 40, 50, 60, 70, 75, 80, 90 or 95 residues)). The activity of a polypeptide having a sequence that corresponds to one or more of the consensus sequences disclosed herein and containing any number of residues inserted at one or more of the ".*" positions can be evaluated using methods that are described herein.

Non-limiting representative polypeptides that contain the consensus sequence shown in SEQ ID NO:1069 include the polypeptide having the sequence shown in SEQ ID NO:870 and Consensus sequence B (SEQ ID NO:1070).

Comparison Between SEQ ID NO:870, 870 T242N, DAT 4978 and DAT 4978 T243N, Tagged and Untagged

*E. coli* BL21 DE3 cells expressing the polypeptides having the sequence of SEQ ID NO:870, 870 T242N, DAT 4978 and DAT 4978 T243N were grown in 50 mL of Overnight Express (Novagen) in a 250 mL baffled flask overnight at 30° C. and 250 rpm. The cells were collected by centrifugation when the optical density at 600 nm was greater than 10. Cell extracts were prepared as described in Example 4. Total protein and DAT concentrations were determined as described in Example 4.

*E. coli* BL21 DE3 cultures expressing C-terminal tagged SEQ ID NO:870, 870 T242N, DAT 4978 and DAT 4978 T243N polypeptides were grown in 200 mL of Overnight Express (Novagen) in a 1000 mL baffled flask overnight at 30° C. and 250 rpm. Two cultures of each clone were grown. The cells were pooled and collected by centrifugation when at an optical density at 600 nm of over 10. Cell extracts were created by the addition of 50 mL of Bug Buster Primary Amine Free (Novagen) with 50 μl of Benzonase Nuclease (Novagen), 0.75 μl of rLysozyme (Novagen), and 250 μl of Protease Inhibitor Cocktail II (Calbiochem). The cells were incubated for 15 minutes at room temperature with gentle rocking. The extracts were centrifuged at 45,000×g for 10 minutes.

The His-tagged proteins were purified as described in the methods section using GE Healthcare (Piscataway, N.J.) Chelating Sepharose™ Fast Flow resin. The purified protein was desalted using a PD10 column into 100 mM potassium phosphate, pH 7.8 (for DAT 4978 and DAT 4978 T243N polypeptides) or 100 mM EPPS pH 8.2 (for SEQ ID NO:870 and 870 T242N polypeptides), both buffers contained 50 μM PLP.

An R,R monatin formation assay was performed as described in Example 5 with a DAT concentration of 0.5 mg/mL. Aliquots were taken at 2.25, 4.5, 9 and 24 hours, pH adjusted with formic acid, and frozen. An extra aliquot was taken at the final time point without formic acid addition for determination of stereoisomeric distribution using the FDAA derivatization method described in Example 3. The samples were thawed and centrifuged for 5 minutes and the supernatant filtered with a 0.2 μm nylon membrane filter. Samples were submitted for monatin analysis using the LC/MS/MS method described in Example 3. The results are shown in Table 17, in ppm monatin formed. The far right column is the % R,R monatin formed at the end of the experiment.

TABLE 17

| DAT polypeptide (SEQ ID NO) | 2.25 hr | 4.5 hr | 9 hr | 24 hr | % R,R |
|---|---|---|---|---|---|
| DAT 4978 | 330 | 676 | 1470 | 2384 | 92.3 |
| DAT 4978 T243N | 1392 | 2856 | 4068 | 3688 | 98.2 |
| 870 | 395 | 952 | 1896 | 2998 | 97.8 |
| 870 T242N | 1416 | 2936 | 3868 | 3976 | 99.3 |
| DAT 4978 6xHis tagged | 362 | 887 | 1664 | 2818 | 96.5 |
| DAT 4978 T243N 6xHis tagged | 1364 | 2298 | 3464 | 4440 | 98.9 |
| 870 6xHis tagged | 228 | 688 | 1508 | 3138 | 98.1 |
| 870 T242N 6xHis tagged | 746 | 2020 | 3962 | 4552 | 99.5 |

The overall activity and stereospecificity of the C-terminally tagged and untagged enzymes are very similar. In addition, it is expected that the presence of activity in a polypeptide encoded from a subcloned nucleic acid is predictive of the presence of activity in the corresponding polypeptide encoded from the full-length or wild type nucleic acid.

Example 11

Analysis of DATs

*E. coli* HMS174 containing DAT nucleic acids in the pSE420-cHis vector encoding the polypeptides having the sequence of SEQ ID NO:880, 882, and 884 were streaked onto agar plates containing LB medium with ampicillin. One skilled in the art can synthesize the genes encoding these D-aminotransferases using assembly PCR techniques such as those described in Example 4. Single colonies were used to innoculate 3 mL of LB medium containing ampicillin (100 μg/mL). Five hundred μl was used to inoculate 50 mL of the same medium in a 250 baffled flask. The cells were grown at 30° C. to approximately an OD$_{600nm}$ of 0.4, and IPTG was added to a final concentration of 1 mM. Cells were grown at 30° C. for 4 hours and collected by centrifugation.

Cell extracts were prepared as described in the Example 4. Total protein and DAT polypeptide concentrations were determined as described in Example 4. SEQ ID NO:882 and 884 expressed well and were present at high levels in the soluble fraction.

An R,R monatin formation assay was performed as described in Example 5 using approximately 0.5 mg/mL of each DAT polypeptide (except that 0.35 mg/mL of the SEQ ID NO:880 polypeptide was utilized). After 2, 8, and 23 hours, an aliquot was taken, formic acid was added to a final concentration of 2%, and the samples were frozen. Samples were then thawed, spun and filtered. Samples were analyzed for monatin using the LC/MS/MS methodology described in Example 3. Results are shown in Table 18.

At the last time point, an extra aliquot was taken (without pH adjustment) to determine the stereoisomeric distribution of the monatin produced using the FDAA derivatization methodology described in Example 3. The percentage of R,R produced is shown in the right hand column of Table 18 below, the balance is predominantly S,R monatin.

TABLE 18

| Polypeptide (SEQ ID NO) | monatin ppm (2 hr) | monatin ppm (8 hr) | monatin ppm (23 hr) | % R,R (23 hr) |
|---|---|---|---|---|
| 880 | 31.6 | 140 | 176 | 97.5 |
| 882 | 31.6 | 872 | 2790 | 99.3 |
| 884 | 79.4 | 644 | 1610 | 100 |
| *B. sphaericus* | 337 | 1518 | 2538 | 96.7 |

Polypeptides having the sequence shown in SEQ ID NO:882 and 884 exhibited good activity in the monatin formation reactions from D-tryptophan.

The stereopurity of the monatin produced was higher when using these DATs as compared to the *B. sphaericus* control enzyme. The DAT nucleic acids encoding DAT polypeptides having the sequence of SEQ ID NO:882 and 884 were subcloned into pET30a vectors as described in Example 4.

Analysis of DAT Polypeptides Having the Sequence of SEQ ID NO:882 and 884 Expressed from the pET30a Vector Cultures of *E. coli* BL21 DE3 containing nucleic acids encoding DAT polypeptides having the sequence of SEQ ID NO:882 and 884 in the pET30a vector were grown in 50 mL of Overnight Express (Novagen) in a 250 mL baffled flask overnight at 30° C. and 250 rpm. The cells were collected by centrifugation when the optical density at 600 nm was greater than 10.

Cell extracts were prepared as described in Example 4. Total protein and DAT polypeptide concentrations were determined as described. Total and soluble protein samples were analyzed using a 4-15% gradient acrylamide gel as well as by the Experion system. Expression was predicted to be approximately 30% by the Experion software. Visible bands were seen for both the total protein and soluble protein (cell-free extract) fractions.

A monatin formation assay was performed as described in Example 5 with both 0.5 and 2 mg/mL DAT polypeptide concentrations. Purified *B. sphaericus* DAT was used as a control. After 2, 4.5, 9, 24, 36 and 48 hrs, an aliquot was taken, formic acid was added to a final concentration of 2%, and the samples were frozen. Samples were then thawed, spun and filtered. Samples were analyzed for monatin using the LC/MS/MS methodology described in Example 3. The samples were qualitatively analyzed for HMG levels. Additional aliquots were taken (without pH adjustment) for stereoisomeric analysis using the FDAA derivatization methodology described in Example 3. The results are shown in Tables 19 and 20.

TABLE 19

| DAT polypeptide (SEQ ID NO) | Monatin (ppm) 2 hrs | Monatin (ppm) 4.5 hrs | Monatin (ppm) 9 hrs | Monatin (ppm) 24 hrs | Monatin (ppm) 36 hrs | Monatin (ppm) 48 hrs |
|---|---|---|---|---|---|---|
| 882 (0.5 mg/mL) | 61 | 274 | 780 | 1802 | 2172 | 2170 |
| 882 (2 mg/mL) | 985 | 2452 | 3232 | 3128 | 3082 | 3158 |
| 884 (0.5 mg/mL) | 149 | 362 | 656 | 1394 | 1756 | 2158 |
| 884 (2 mg/mL) | 811 | 1628 | 2466 | 2988 | 3178 | 2864 |
| *B. sphaericus* (0.5 mg/mL) | 362 | 860 | 1268 | 2362 | 2532 | 2804 |
| *B. sphaericus* (2 mg/mL) | 1335 | 2344 | 3154 | 3866 | 3842 | 4008 |

TABLE 20

Stereopurities of monatin produced at selected timepoints

| DAT polypeptide (SEQ ID NO) | 24 hrs (% R,R) | 48 hrs (% R,R) |
|---|---|---|
| 882 (2 mg/mL) | 95.4 | 94.1 |
| 884 (2 mg/mL) | 99.6 | 99.4 |
| Bs DAT (2 mg/mL) | 95.8 | 93.3 |

Polypeptides having the sequence shown in SEQ ID NO:882 and 884 exhibited good monatin formation activity and stereospecifity, and appeared to produce less HMG than the *B. sphaericus* control during the initial timepoints. Polypeptides having the sequence of SEQ ID NO:882 exhibited similar initial monatin formation rates but appeared to have plateaued in this experiment at a lower monatin titer.

Example 12

Analysis of DATs in pSE420-cHis, and of a DAT in pET30a

The open reading frames encoding DAT polypeptides having the sequence of SEQ ID NO:898, 900, 902, 904, 906, 910, and 896 were evaluated. One of ordinary skill in the art can synthesize the genes encoding these D-aminotransferases using assembly PCR techniques such as those described in Example 4.

A culture of *E. coli* BL21 DE3 containing a nucleic acid encoding a DAT polypeptide having the sequence shown in SEQ ID NO:896 in the pET30a vector (subcloned as described in Example 4) was grown in 50 mL of Overnight Express (Novagen) in a 250 mL baffled flask overnight at 30° C. and 250 rpm. The cells were collected by centrifugation when the optical density at 600 nm was greater than 10.

Top10 (Invitrogen, Carlsbad, Calif.) *E. coli* cells were transformed with the pSE420-cHis plasmid containing the DAT nucleic acids having the sequence shown in SEQ ID NO:897, 899, 901, 903, 905, and 909 and plated on LB medium containing ampicillin (100 µg/mL). Five hundred µl of an overnight culture was used to inoculate 50 mL of the same medium in a 250 baffled flask. The cells were grown at 30° C. to an $OD_{600nm}$ of approximately 0.4 and IPTG was added to a final concentration of 1 mM. Cells were grown at 30° C. for 4 hours and collected by centrifugation.

Cell extracts were prepared as described in Example 4. Soluble protein and estimated DAT concentrations were determined as described in Example 4.

An R,R monatin formation assay was performed as described in Example 5 with DAT polypeptide concentrations of 0.5 mg/mL, except that 0.3 mg/mL of the polypeptide having the sequence of SEQ ID NO:896 was used; 0.06 mg/mL of the polypeptide having the sequence of SEQ ID NO:898 was used; 0.4 mg/mL of the polypeptide having the sequence shown in SEQ ID NO:900 was used; 0.1 mg/mL of the polypeptide having the sequence of SEQ ID NO:902 was used; and 0.12 mg/mL of the polypeptide having the sequence of SEQ ID NO:904 was used. As positive controls, SEQ ID NO:870, 870 T242N, and purified *B. sphaericus* were tested at DAT polypeptide concentrations of 0.5 mg/mL. After 2, 6, and 24 hours, an aliquot was taken, formic acid was added to a final concentration of 2% and the samples were frozen. Samples were then thawed, spun and filtered. Samples were analyzed for monatin using the LC/MS/MS methodology described in Example 3. Additional aliquots were taken for stereoisomeric distribution analysis and were not treated with formic acid. The results for the 24 hour time point are shown in Table 21. The DAT nucleic acid encoding the DAT polypeptide having the sequence shown in SEQ ID NO:908 was not subcloned and could not be assayed.

TABLE 21

| Polypeptide (SEQ ID NO) | monatin 2 hrs (ppm) | monatin 6 hrs (ppm) | monatin 24 hrs (ppm) | 24 hr % R,R |
|---|---|---|---|---|
| *B. sphaericus* | 261 | 1203 | 2604 | 95.6 |
| 870 | 193 | 1067 | 2490 | 96.8 |
| 870 T242N | 813 | 2230 | 3380 | 98.8 |
| 896 | 30 | 127 | 286 | 99.8 |
| 898 | nd | 3 | 15 | 95.7 |
| 900 | 4 | 16 | 56 | 92.9 |
| 902 | 144 | 411 | 1209 | 96.7 |
| 904 | nd | 1 | 4 | 92.3 |
| 906 | 14 | 18 | 25 | 98 |
| 910 | 487 | 1154 | 2770 | 94.5 | nd = not detectable under conditions tested

DAT polypeptides having the sequence shown in SEQ ID NO:910 and 902 had high levels of activity for the monatin formation reactions, and produced fairly high levels of R,R monatin. Results indicated that the DAT polypeptide having the sequence shown in SEQ ID NO:870 exhibited comparable activity to that of the wildtype polypeptide having the sequence shown in SEQ ID NO:910 under the conditions tested; however, the T242N mutation in the SEQ ID NO:870 polypeptide makes a large improvement in activity and stereospecificity of the enzyme.

Example 13

Analysis of DATs

Plasmids (pSE420-cHis) containing the nucleic acid sequences encoding SEQ ID NO:912, 914, 916, 918, 920, 922, 924, and 926 DATs were obtained. One skilled in the art could clone the genes using any number of gene assembly protocols such as the one described in Example 4.

*E. coli* Top10 (Invitrogen) cells were transformed with the pSE420-cHis plasmids containing DAT polypeptides having the sequence of SEQ ID NO:912, 914, 916, 918, 920, 922, 924, and 926 and plated on LB medium containing ampicillin (100 µg/mL). Five hundred µl of the overnight culture was used to inoculate 50 mL of the same medium into 250 mL baffled flasks. Cultures were grown at 30° C. to an $OD_{600nm}$ of approximately 0.4. IPTG was added to a final concentration of 1 mM. Cells were grown at 30° C. for 4 hours and collected by centrifugation.

Cell extracts were prepared as described in Example 4. Total soluble protein and DAT protein concentrations were determined as described in Example 4. Most of the DAT polypeptides that were expressed were soluble except for the SEQ ID NO:916 polypeptide, which was only partially soluble.

An R,R monatin formation assay was performed as described in Example 5, with a DAT polypeptide concentration targeted to about 0.25 mg/mL; except that 0.1 mg/mL of the SEQ ID NO:922 polypeptide was used and 0.2 mg/mL of the SEQ ID NO:926 polypeptide was used. As a positive control, purified *B. sphaericus* DAT was tested at a 0.25 mg/mL concentration. After 2, 8 and 24 hours, an aliquot was taken and formic acid was added to a final concentration of 2%, and the samples were frozen. Samples were then thawed, spun and filtered. Samples were analyzed for monatin using the LC/MS/MS methodology described in Example 3. The results are shown in Table 22.

TABLE 22

| Polypeptides (SEQ ID NO) | monatin (ppm) 2 hours | monatin (ppm) 8 hours | monatin (ppm) 24 hours |
|---|---|---|---|
| B. sphaericus | 179 | 774 | 1482 |
| 912 | 0.2 | 2 | 2 |
| 914 | 4 | 22 | 62 |
| 916 | 0.6 | 2 | 6 |
| 918 | 158.8 | 402 | 496 |
| 920 | 5 | 40 | 96 |
| 922 | 0.2 | 2 | 2 |
| 924 | nd | nd | nd |
| 926 | 1.2 | 12 | 30 | nd = not detected under conditions assayed

DAT nucleic acids having the sequence shown in SEQ ID NO:169, 171, 167, 173 and 175 (encoding DAT polypeptides having the sequence shown in SEQ ID NO:170, 172, 168, 174 and 176) were obtained as PCR products and were subcloned in pET30a as described in Example 4. One of ordinary skill in the art could reconstruct the genes using any number of gene assembly methods such as the one described in Example 4.

*E. coli* BL21 DE3 cells containing DAT nucleic acids having the sequence of SEQ ID NO:169, 171, 167, 173 and 175 in the pET30a vector were grown in 50 mL of Overnight Express (Novagen) in a 250 mL baffled flask, overnight at 30° C. and 250 rpm. The cells were collected by centrifugation when the optical density at 600 nm was greater than 10.

Cell extracts were prepared as described in the Example 4. Total soluble protein and DAT protein concentrations were determined as described in Example 4. The polypeptide having the sequence of SEQ ID NO:170 (encoded by the DAT nucleic acid having the sequence of SEQ ID NO:169) did not appear to be soluble, which may have impeded activity assays.

An R,R monatin formation assay was performed as described in Example 5 using a DAT polypeptide concentration of 0.5 mg/mL, except that 0.25 mg/mL of the SEQ ID NO:170 polypeptide was used. As a positive control, purified *B. sphaericus* DAT was tested at a 0.5 mg/mL concentration. After 2, 8 and 24 hours, an aliquot was taken, formic acid was added to a final concentration of 2%, and the samples were frozen. Samples were then thawed, spun and filtered, and analyzed for monatin using the LC/MS/MS methodology described in Example 3. Results are shown in Table 23.

TABLE 23

| Polypeptides (SEQ ID NO) | monatin (ppm) 2 hr | monatin (ppm) 8 hr | monatin (ppm) 24 hr |
|---|---|---|---|
| B. sphaericus | 456 | 1502 | 2970 |
| 170 | 2 | 8 | 14 |
| 172 | 5 | 20 | 60 |
| 168 | 15 | 68 | 186 |
| 174 | 1 | 4 | 8 |
| 176 | 451 | 1508 | 2744 |

Samples (without pH adjustment) were analyzed to determine % R,R using the FDAA derivatization protocol described in Example 3. The monatin produced by DAT polypeptide having the sequence shown in SEQ ID NO:176 was 99.6% R,R after 24 hrs compared to that produced by *B. sphaericus*, which was 95.2% R,R at the same timepoint. The activity and stereopurity resulting from the DAT polypeptide having the sequence of SEQ ID NO:176 were both quite high, and the corresponding nucleic acid was subcloned as a C-terminal tagged protein as described in Example 4 for more quantitative studies.

Characterization of SEQ ID NO:176 C-His-Tagged Protein

The nucleic acid having SEQ ID NO:175, which encodes the polypeptide having the sequence of SEQ ID NO:176, was cloned into pET30a without a stop codon so that it could be expressed as a fusion protein with a 6×His-tag on the C-terminus. The protein was purified using the His-bind resin described in Example 4. When the fusion protein was eluted from the PD-10 desalting column, a yellow precipitate formed in the solution. A yellow residue was also observed on the column. The yellow color usually is indicative of the presence of a PLP-binding protein. In an effort to prevent the precipitation of the PLP-binding protein at the desalting step, different buffers (100 mM phosphate and 100 mM EPPS with or without 10% glycerol) at two pH values (7.8 and 8.2) were utilized. None of the buffers tried appeared to completely prevent the precipitation.

The monatin assay was performed using a well-mixed heterogeneous protein solution and a DAT polypeptide concentration of 0.5 mg/mL. The results are shown in Table 24. The purified SEQ ID NO:176 DAT polypeptide (C-tagged) showed comparable activity to the positive control DAT polypeptide from *B. sphaericus*; however, the activity appeared to be lower than the activity exhibited by the mutant polypeptides having the sequence of SEQ ID NO:870 T242N or SEQ ID NO:870 T242N.

TABLE 24

| | Monatin Production (ppm) | | | |
|---|---|---|---|---|
| Polypeptide (SEQ ID NO) | 2 hr | 4 hr | 8 hr | 24 hr |
| B. sphaericus | 262 | 676 | 1044 | 2150 |
| 870 | 332 | 678 | 1346 | 2826 |
| 870 T242N | 942 | 1938 | 2834 | 4004 |
| 176 | 208 | 392 | 732 | 1806 |

Example 14

Evaluation of DATs

The open reading frames encoding 29 DATs were obtained as PCR products. It is noted that one of ordinary skill in the art can synthesize the genes encoding the DATs using assembly techniques such as those described in Example 4. The DAT nucleic acids were subcloned into the pET30a vector and expressed as untagged proteins as described in Example 4. The desalted cell-free extracts (prepared as described in Example 4) were used in monatin formation assays. A DAT polypeptide concentration of 0.5 mg/mL was used for the monatin assay except for the following polypeptides (amounts used in parentheses): the SEQ ID NO:156 polypeptide (0.4 mg/mL), the SEQ ID NO:182 polypeptide (0.45 mg/mL), the SEQ ID NO:240 polypeptide (0.47 mg/mL), and the SEQ ID NO:204 polypeptide (0.42 mg/mL).

Most of the DAT polypeptides showed undetectable to low monatin production under the conditions assayed as compared to positive control enzymes. Most of the expressed DAT polypeptides were soluble as determined by the Experion; however, the polypeptides having SEQ ID NO:204 and 240 were expressed at very low levels and may not have been very soluble. On the other hand, the polypeptide having SEQ ID NO:220 was predicted to be 68% of the total soluble protein as judged by the Experion software.

The monatin production results are shown in Table 25 and 26. At 24 h, the DAT polypeptide having SEQ ID NO:156 and 214 produced 40-50% of monatin as compared to the positive control enzyme, the DAT from *B. sphaericus*. The most active DAT polypeptide was the SEQ ID NO:220 polypeptide. Approximately 4 h after the reaction was started, the monatin concentration reached a maximum. It is expected that the mature protein of SEQ ID NO:156 (without the predicted leader sequence) is the active component of the DAT polypeptide and, therefore, the protein can be produced recombinantly with the leader sequence absent.

TABLE 25

Monatin Formed (ppm)

| Polypeptide (SEQ ID NO) | 2 hr | 4 hr | 8 hr | 24 hr |
|---|---|---|---|---|
| 178 | 11 | 24 | 62 | 194 |
| 180 | nd | nd | nd | nd |
| 154 | 52 | 103 | 166 | 178 |
| 182 | nd | nd | nd | nd |
| 218 | 1.6 | 2.8 | 274 | 12 |
| 188 | 2.4 | 5.2 | 10 | 22 |
| 190 | 3.8 | 9.4 | 22 | 42 |
| 208 | 1 | 1.2 | nd | nd |
| 220 | 2418 | 3563 | 3812 | 3882 |
| 196 | 1 | 1.8 | nd | 8 |
| 156 | 64.8 | 156 | 296 | 796 |
| *B. sphaericus* | 422 | 791 | 1302 | 2124 | nd = not detectable under conditions assayed

TABLE 26

Monatin Formed (ppm)

| Polypeptide (SEQ ID NO) | 2 | 4 | 8 | 24 |
|---|---|---|---|---|
| 166 | nd | nd | 1 | nd |
| 216 | 69 | 91 | 109 | 134 |
| 200 | nd | nd | 1 | 1 |
| 198 | nd | nd | nd | nd |
| 210 | 1.6 | 3.8 | 6.2 | 15.2 |
| 202 | 3.4 | 6.2 | 12.2 | 29.8 |
| 222 | 3.6 | 7 | 12.8 | 25.8 |
| 236 | nd | nd | nd | nd |
| 204 | nd | nd | nd | 3.6 |
| 238 | 10.4 | 21.8 | 46.4 | 115.6 |
| 240 | 3 | 6 | 12.4 | 32.2 |
| 224 | 39.8 | 85 | 171.8 | 268.8 |
| 226 | 2.6 | 5.8 | 12.4 | 30.6 |
| 228 | 4.2 | 9.8 | 21.4 | 66.8 |
| 230 | 9.2 | 21.8 | 42.2 | 94.4 |
| 232 | 3.6 | 9.4 | 21.6 | 57 |
| 246 | nd | nd | nd | nd |
| 214 | 160 | 327 | 694 | 1346 |
| *B. sphaericus* | 393 | 986 | 1624 | 2597 | nd = not detectable under conditions assayed

The high activity of the SEQ ID NO:220 polypeptide was confirmed in another monatin formation assay where the SEQ ID NO:220 polypeptide was compared to the SEQ ID NO:870, 870 T242N, and *B. sphaericus* DAT polypeptides. A DAT polypeptide concentration of 0.1 mg/mL and 0.5 mg was used for each of the DAT polypeptides assayed. The results are shown in Table 27. Due to the high degree of activity of the DAT polypeptides assayed, the monatin samples had to be diluted 100-fold to be within the quantitative range of the instruments used (as opposed to a typical 10- or 20-fold dilution).

TABLE 27

Monatin Formed (ppm)

| DAT Polypeptide (SEQ ID NO) | 2 hr | 4 hr | 8 hr | 24 hr |
|---|---|---|---|---|
| *B. sphaericus* (0.1 mg/mL) | 74 | 170 | 309 | 728 |
| *B. sphaericus* (0.5 mg/mL) | 510 | 921 | 1068 | 2704 |
| 870 (0.1 mg/mL) | 28 | 81 | 179 | 706 |
| 870 (0.5 mg/mL) | 399 | 847 | 1466 | 2916 |
| 870 T242N (0.1 mg/mL) | 93.2 | 245.8 | 582.4 | 1270 |
| 870 T242N (0.5 mg/mL) | 1158.8 | 2026 | 3202 | 4126 |
| 220 (0.1 mg/mL) | 965.8 | 1512 | 2330 | 3788 |
| 220 (0.5 mg/mL) | 2950 | 4302 | 4618 | 4488 |

The percentage of R,R formed by the DAT polypeptide having SEQ ID NO:220 in the above experiments was determined using the FDAA derivatization methodology described in Example 3. The DAT polypeptide having the sequence of SEQ ID NO:220 is highly stereospecific, producing 99.3% R,R monatin at 24 hours as compared to 92.9% R,R for *B. sphaericus*. In another assay, the SEQ ID NO:220 polypeptide produced 99.8% R,R-monatin.

Figure 3:
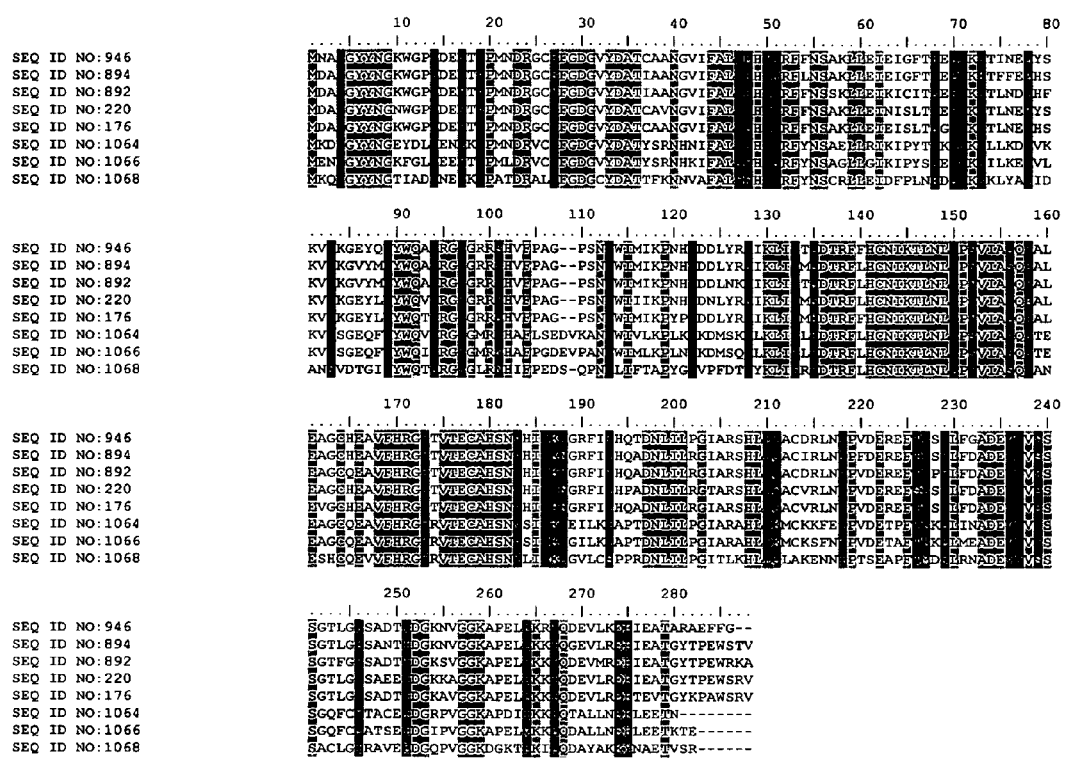

The DAT polypeptide having the sequence of SEQ ID NO:220 is a novel protein that is 62% identical at the protein level to the *C. beijerinckii* DAT polypeptide shown in Example 9. The SEQ ID NO:220 polypeptide has 86%-90% primary sequence homology to other highly active DAT polypeptides (e.g., those having the sequence shown in SEQ ID NO:892 and 894 (Example 8), 946 (Example 7) and 176 (Example 13)). These highly active and novel DAT polypeptides were uncharacterized prior to this work, and these enzymes exhibited higher activity and stereospecificity for R,R monatin production reactions than any of the published *Bacillus*-like D-aminotransferases. FIG. 3 shows an alignment of these related D-aminotransferases and the consensus sequence motifs they have in common are described below.

```
Consensus Sequence C
                                                       (SEQ ID NO: 1071)
M.*GYYNG.*P.*DR.*FGDG.*YDAT.*N.*FAL.*H.*RF.*NS.*LL.*I.*K.*YWQ.*RG.*G.*R.*

H.*F.*N.*I.*P.*KLI.*DTRF.*HCNIKTLNL.*P.*VIA.*Q.*E.*C.*E.*VFHRG.*VTECAHSN.*I.

*NLIL.*G.*HL.*P.*E.*F.*L.*ADE.*V.*SS.*DG.*GGK.*K.*Q.*T

Consensus Sequence D
                                                       (SEQ ID NO: 1072)
M.{3}GYYNG.{10}P.{2}DR.{3}FGDG.YDAT.{3}N.{3}FAL.{2}H.{2}RF.NS.{2}LL.I.{9}K.

{17}YWQ.{2}RG.G.R.H.F.{5,7}N.{2}I.{3}P.{10}KLI.{3}DTRF.HCNIKTLNL.P.VIA.Q.{3}E.

{2}C.E.VFHRG.{2}VTECAHSN.{2}I.{11}DNLIL.G.{4}HL.{9}P.{2}E.{2}F.{4}L.{2}ADE.

{2}V.SS.{10}DG.{3}GGK.{5}K.{2}Q.{10}T
```

-continued

Consensus Sequence E (SEQ ID NO: 1073)

M.*[LV]GYYNG.*[LI].*[ML].*[VI]P.*DR.*[YF]FGDG.*YDAT.*N.*FAL[DE][ED]H[IL][DE]

RF.*NS.*LL*I.*[KR].*[EQ][LMV]K[KE].*[MV].*[DE].*[VL]YWQ.*[TS]RG[TS]G.*R[NS]

H.*F.*N[LI].*I.*P.*[IVL].*[KE].*KLI[TS].*[ED]DTRF.*HCNIKTLNL[IL]P[NS]VIA[SA]Q[R

K].*E.*C.*E.*VFHRG[ED].*VTECAHSN[V1].*I[IL][KR][ND].*[TS].*DNLIL.*G.*HL[LI][Q

K].*[IV]P.*E.*F[TS][LM].*[ED]L.*ADE[VI][LI]V[ST]SS.*[LM1].*[IL]DG.*GGK.[LVI]K.*

[IL]Q.*[EK][FY].*T

Similar to PERL regular expression convention language (perldoc.perl.org), ".*" indicates that any number of amino acid residues may be present from any of the 20 proteinogenic amino acids; [ ] indicates that any one of the amino acids in the brackets can be present; ".{#}" indicates that any of the 20 proteinogenic amino acids can be present as long as the number of residues matches the number (#) indicated in the brackets.

With respect to the use of ".*" in Consensus sequence C, the number of amino acids at any of the ".*" positions can vary, for example, from about 0 to about 20 residues (see, for example, Consensus sequences D (SEQ ID NO:1072) and E (SEQ ID NO:1073)) or from about 20 residues up to about 100 residues, or the number of amino acids can be much larger, for example, up to 1000 or more residues. Without limitation, an insertion at one or more of the ".*" positions can correspond to, for example, a domain such as (but not limited to) a chitinase binding domain (e.g., from *Pyrococcus litriosus* (Accession No. 2CZN_A) or *P. burkholderia* (Accession No. YP_331531) or a cellulose binding domain (e.g., from *Cellulomonas fimi* (Accession No. 1EXH_A) or *Clostridium stercorarium* (Accession No. 1UY1_A). In some embodiments (without limitation), five or less of the positions designated ".*" each contain an insertion of, for example, greater than about 20 residues (e.g., greater than about 100 residues). In other embodiments (without limitation), five or more of the positions designated ".*" each contains an insertion of less than about 100 residues (e.g., less than about 20 residues, e.g., 3, 5, 10, 20, 25, 30, 40, 50, 60, 70, 75, 80, 90, or 95 residues). The activity of a polypeptide having a sequence that corresponds to one or more of the consensus sequences disclosed herein and containing any number of residues inserted at one or more of the ".*" positions can be evaluated using methods that are described herein.

Non-limiting representative polypeptide that contain the consensus sequence shown in SEQ ID NO:1071 include SEQ ID NO:220, 892, 894, 176 and 946 and Consensus sequences D (SEQ ID NO:1072) and E (SEQ ID NO:1073)). It is expected that any D-aminotransferase exhibiting any of consensus sequences C, D, or E would be active in monatin formation pathway steps.

Characterization of a c-His-Tagged Polypeptide Having the Sequence of SEQ ID NO:220

The DAT nucleic acid having the sequence of SEQ ID NO:219 (encoding the polypeptide of SEQ ID NO:220) was cloned into pET30a without a stop codon such that it was expressed as a fusion protein with a 6×His-tag on the C-terminus (as described in Example 4). The fusion protein was purified using the His-Bind column (Novagen) described in Example 4. The eluate from the PD-10 desalting column formed a yellow precipitate. Yellow residue was also observed on the column. Monatin assays were done using a well-mixed heterogenous protein solution. Amounts of DAT polypeptide used are indicated in parentheses in the far left column. The notation w/Trp indicates that the enzyme was incubated with 10 mM D-tryptophan overnight on ice. Results are shown in Table 28.

TABLE 28

| Polypeptide (SEQ ID NO) | Monatin formed (ppm) | | | |
|---|---|---|---|---|
| | 2 hr | 4 hr | 8 hr | 24 hr |
| *B. sphaericus* (0.5 mg/mL) | 382 | 660 | 1021 | 1986 |
| 870 T242N (0.1 mg/mL) | 69 | 205 | 412 | 1074 |
| 870 T242N w/Trp (0.1 mg/mL) | 63 | 163 | 383 | 978 |
| 870 T242N (0.5 mg/mL) | 919 | 1698 | 2356 | 3130 |
| 870 T242N w/ Trp (0.5 mg/mL) | 772 | 1519 | 2294 | 3023 |
| 220 (0.1 mg/mL) | 847 | 1462 | 2202 | 3004 |
| 220 (0.1 mg/mL) | 811 | 1522 | 2202 | 2887 |
| 220 w/ Trp (0.1 mg/mL) | 537 | 1080 | 1590 | 2401 |
| 220 (0.5 mg/mL) | 2885 | 3446 | 3813 | 4066 |
| 220 w/ Trp (0.5 mg/mL) | 1933 | 3223 | 3939 | 3911 |

The reaction containing 0.1 mg/mL of the SEQ ID NO:220 polypeptide showed a similar monatin formation time course as the reaction containing 0.5 mg/mL of the SEQ ID NO:870 T242N polypeptide. Addition of D-tryptophan (10 mM) to the solution containing the purified protein eliminated the precipitation. Activity loss was observed for the sample in which SEQ ID NO:220 was incubated with D-tryptophan (10 mM) overnight on ice, but no negative effect was observed when the SEQ ID NO:870 T242N polypeptide was treated with D-tryptophan (10 mM). The presence of HMG was also analyzed qualitatively for reactions catalyzed by the SEQ ID NO:220 polypeptide by comparing peak areas. When both DAT polypeptides were utilized at a concentration of 0.5 mg/mL, the reaction catalyzed by the SEQ ID NO:220 polypeptide formed around 40% of the HMG compared to the reaction containing the SEQ ID NO:870 T242N polypeptide. Earlier time points show an even more pronounced difference between the two enzymes.

In an attempt to prevent the protein precipitation during the purification of the SEQ ID NO:220 polypeptide, DTT (5 mM) was included in all the buffers including the Bugbuster reagent, the buffers for His-Bind column and the buffer for PD-10 column. No precipitation was observed after the desalting column, and no negative effect was observed on the activity of the SEQ ID NO:220 polypeptide when DTT was included during purification or added into purified protein solution at a concentration of 2 mM. Data for monatin formation assays are shown in Table 29. The amount of DAT polypeptide used is indicated in the left column in parentheses. "added DTT" indicates that 2 mM DTT was added to resolubilize the protein after purification; and "purified w/DTT" indicates that 5 mM DTT was present throughout the purification.

TABLE 29

| Monatin Formed (ppm) | | | |
|---|---|---|---|
| Polypeptide (SEQ ID NO) | 2 hr | 4 hr | 24 hr |
| B. sphaericus (0.5 mg/mL) | 426 | 965 | 2638 |
| 870 T242N (0.5 mg/mL) | 977 | 1916 | 4227 |
| 220 (0.1 mg/mL) | 1214 | 2163 | 3964 |
| 220 (0.5 mg/mL) | 3534 | 4246 | 4415 |
| 220 added DTT (0.1 mg/mL) | 1287 | 2202 | 3566 |
| 220 added DTT (0.4 mg/mL) | 3495 | 4833 | 5082 |
| 220 purified w/ DTT (0.1 mg/mL) | 1204 | 2169 | 3997 |
| 220 purified w/ DTT (0.5 mg/mL) | 3562 | 4110 | 4353 |

The highly desirable properties of the SEQ ID NO:220 polypeptide make it an excellent candidate for further mutagenesis or directed evolution experiments.

Site-Directed Mutagenesis of the SEQ ID NO:220 Polypeptide

A loop region of the DAT polypeptide related to the *Bacillus* DAT polypeptide was identified as being important for the substrate specificity and stereospecificity of the enzymes (Ro et al., 1996, *FEBS Lett*, 398:141-145; Sugio et al., 1995, *Biochemistry* 34:9661-9669; and EP 1 580 268). One key residue in this region is a T at residue 242 (in the DAT polypeptide from ATCC #4978, this position corresponds to a Tat residue 243). A T242N mutant of the SEQ ID NO:870 polypeptide showed improvement in both activity and stereospecificity, as did the T243N mutant of DAT 4978 (see Example 10). Primary sequence alignment of the SEQ ID NO:220 polypeptide with the SEQ ID NO:870 polypeptide showed only 35% amino acid sequence identity and 65% homology. The T242 residue in SEQ ID NO:870 aligned with a G240 residue in SEQ ID NO:220, which is followed by a T241 residue. Using Accelrys DS Modeler software for both proteins (with *Bacillus* YM-1 structures as templates), it was difficult to overlap the loop region of the SEQ ID NO:870 polypeptide with the SEQ ID NO:220 polypeptide. Therefore, both amino acids were chosen as targets for site-directed mutagenesis.

A mutant polypeptide designated SEQ ID NO:220 G240N and SEQ ID NO:220 T241N were generated by site-directed mutagenesis of the corresponding nucleic acid (SEQ ID NO:219) as described in Example 4. The two mutant polypeptides were expressed and purified as 6×His-tagged fusion proteins that were used in the monatin formation assay. Yellow precipitation was observed at the desalting step for both of the mutant SEQ ID NO:220 polypeptides. Results are shown in Tables 30 and 31 for monatin formation assays. The amount of D-aminotransferase used is indicated in the left-hand column in parentheses. Different preparations of the SEQ ID NO:220 polypeptide were utilized in the assay. "ferm" indicates that the SEQ ID NO:220 polypeptide used was produced in a fermentor as described in Example 15.

TABLE 30

| Monatin Produced (ppm) | | | | |
|---|---|---|---|---|
| Polypeptide (SEQ ID NO) | 2 hrs | 4 hrs | 8 hrs | 24 hrs |
| B. sphaericus (0.5 mg/mL) | 440 | 777 | 1510 | 2621 |
| 870 T242N (0.5 mg/mL) | 961 | 1913 | 2793 | 3904 |
| ferm 220 (0.1 mg/mL) | 1396 | 2379 | 3217 | 3770 |
| ferm 220 (0.2 mg/mL) | 2301 | 3277 | 3789 | 4328 |
| ferm 220 w/ DTT (0.1 mg/mL) | 1434 | 2384 | 3109 | 3730 |
| ferm 220 w/ DTT (0.2 mg/mL) | 2423 | 3568 | 3859 | 4755 |
| 220 (0.1 mg/mL) | 1109 | 1912 | 2809 | 3713 |
| 220 T241N (0.1 mg/mL) | 554 | 856 | 1084 | 1986 |

TABLE 31

| Monatin Formed (ppm) | | | | |
|---|---|---|---|---|
| Polypeptide (SEQ ID NO) | 2 hr | 4 hr | 8 hr | 24 hr |
| B. sphaericus (0.5 mg/mL) | 634 | 938 | 1651 | 2754 |
| 870 T242N (0.5 mg/mL) | 1422 | 1922 | 3211 | 3793 |
| ferm 220 (0.1 mg/mL) | 1976 | 2505 | 3442 | 4211 |
| ferm 220 (0.2 mg/mL) | 3198 | 3430 | 4452 | 4639 |
| 220 G240N (0.1 mg/mL) | 3 | 5 | 14 | 42 |
| 220 G240N (0.2 mg/mL) | 9 | 17 | 46 | 94 |

A very small amount of monatin (95.7% R,R monatin) was formed in the reaction catalyzed by the mutant SEQ ID NO:220 G240N polypeptide. The mutant SEQ ID NO:220 T241N polypeptide lost about 50% of the activity, but still maintained the stereospecificity (99.7% R,R monatin produced). These results, together with the homology modeling and alignments, suggest that, in the region surrounding residues 242-243 (and potentially beyond), the structure of the SEQ ID NO:220 polypeptide is not similar to the structure of the SEQ ID NO:870 polypeptide or the structure of the *Bacillus*-like DAT polypeptide in the literature. Since there is no x-ray crystal structure, random mutagenesis, combinatorial approaches and other directed evolution approaches of the SEQ ID NO:220 polypeptide and related DAT polypeptides are expected to be highly productive in further improving the enzyme's activity.

Example 15

Production of a DAT in a Fermentor

Bacterial growth media components were from Difco, Fisher Scientific, or VWR; other reagents were of analytical grade or the highest grade commercially available. The fermentation was run in a New Brunswick Scientific (Edison, N.J.) BioFlo 3000® fermenter. Centrifugation was carried out using a Beckman (Fullerton, Calif.) Avanti® J-25I centrifuge with a JLA-16.250 or JA-25.50 rotor.

The DAT nucleic acid encoding the polypeptide having the sequence in SEQ ID NO:220 with a C-terminal His-tag was cloned using Nde I/Xho I restriction sites into the pMet1a vector described in Example 16. The antibiotic marker (bla gene) can further be removed using Psi I restriction enzyme digestion, gel purification of the vector band, self-ligation of the vector ends, transformation into the *E. coli* host, and selection on minimal medium plates that do not contain methionine. Typically, Neidhardt's medium with 15 amino acids is used. The cloning sites were NdeI/XhoI to insert the SEQ ID NO:220 nucleic acid sequence into pMET1a (see Example 16).

The SEQ ID NO:220 DAT polypeptide carrying a C-terminal His-purification tag was produced in a fermentor at the 2.5-L scale, in a fed-batch process that achieves high cell densities and high levels of expression of the desired protein. The protocol and results for growth of *E. coli* strain B834 (DE3)::SEQ ID NO:220cHIS pMET1 are described as follows: Starting from a fresh culture plate (Neidhardt's+15 amino acids, no methionine), the cells were grown in 5 mL of Neidhardt's medium supplemented with 15 amino acids, at 30° C. and 225 rpm for 6-8 h. One mL of the culture was transferred to each of 2 125-mL aliquots of the production medium supplemented with 5 g/L of glucose. The flasks were grown at 30° C. and 225 rpm overnight (16-18 h). A fermentor was charged with 2.5 liters of the production medium, containing (per liter): 2.0 g/L $(NH_4)_2SO_4$; 8.0 g/L $K_2HPO_4$; 2.0 g/L NaCl; 1.0 g/L $Na_3Citrate.2H_2O$; 1.0 g/L $MgSO_4.7H_2O$; 0.025 g/L $CaCl_2.2H_2O$; 0.05 g/L $FeSO_4.7H_2O$; 0.4 mL/L Neidhardt micronutrients, and 2.0 g/L glucose. The fermenter was inoculated with 10% v/v of the overnight culture. Three hours after inoculation, an exponential glucose feed was set up using a 60% w/v glucose solution. The feed was supplied at the required rate to support microbial growth at an exponential rate of 0.15 $h^{-1}$. When the carbon dioxide evolution rate (CER) had reached a value of 100 mmoles/L/h (approximately 21 hours after inoculation; corresponding to a cell biomass of 15-16 g DCW/L), gene expression was induced with a bolus addition of 2 g/L lactose (fed as a 20% solution). The feed was changed from 60% w/v glucose to 50% w/v glucose+10% w/v lactose while the feed rate was fixed to the rate at time of induction. The "50% w/v glucose+10% w/v lactose" feed was maintained for 6 hours. At the end of the fermentation, the cells were harvested by centrifugation at 5000-7000×g for 10 min and frozen as a wet cell paste at −80° C. Cell paste (318 grams) was harvested from 2.8 L of cell broth.

To prepare cell free extract containing the SEQ ID NO:220 polypeptide, 50 g of wet cell paste was suspended in 150 mL of 50 mM EPPS buffer (pH 8.4) containing 50 μM pyridoxal phosphate (PLP) and then disrupted using a Microfluidics homogenizer (Microfluidics, Newton, Mass.) (3 passes at 18,000 psi), maintaining the temperature of the suspension at less than 15° C. The cell debris was removed by centrifugation (20,000×g for 30 minutes). Two mM DTT was added to the clarified cell extract.

To prepare purified SEQ ID NO:220, 2×25 mL aliquots of clarified cell extract were loaded each onto a 45 mL Chelating Sepharose™ Fast Flow resin (nickel(II) form) column that had been previously equilibrated with 50 mM EPPS (pH 8.4) containing 0.05 mM PLP and 200 mM sodium chloride. After loading the sample, the column was washed/eluted successively with 3-5 volumes of the equilibration buffer, 3-5 volumes of the equilibration buffer containing 25 mM imidazole, 3-5 volumes of the equilibration buffer containing 100 mM imidazole and 3-5 volumes of the equilibration buffer containing 500 mM imidazole. The 500 mM imidazole eluent was concentrated 10× with an Amicon (Billerica, Mass.) Centricon-70 centrifugal filter device (MWCO 10 kDa). The imidazole and sodium chloride were removed by passage through disposable GE Healthcare PD10 desalting columns previously equilibrated with 50 mM EPPS (pH 8.4) containing 0.05 mM PLP. The protein concentration of the desalted solution was determined using the Pierce BCA assay kit (Rockford, Ill.). The purity of each fraction and the level of expression in the cell free extract fraction were determined by SDS-PAGE with 4-15% gradient gels. Approximately 450 mg of protein that was ~90% pure was recovered from the 50 mL of clarified cell extract. Two mM DTT was added to 10 mL of the purified protein. The purified protein was dispensed into aliquots (0.5-5 mL) and stored at −80° C.

Bench scale reactions (250 mL) were carried out in 0.7 L Sixfors agitated fermenters (Infors AG, Bottmingen, Switzerland) under a nitrogen headspace. The reaction mix contained 10 mM potassium phosphate, 1 mM $MgCl_2$, 0.05 mM PLP, 200 mM sodium pyruvate and 100 mM D-tryptophan. The reaction mix was adjusted to the appropriate temperature, and adjusted to the appropriate pH with potassium hydroxide. The aldolase described in Example 6 was added as a clarified cell extract at 0.02 mg/mL of target protein. The SEQ ID NO:220 DAT polypeptide was added (either as purified enzyme or as a clarified cell extract) at 0.25 mg/mL of target protein.

The progress of the reactions was followed by measuring monatin concentration using the LC/MS/MS methodology described in Example 3.

Starting with D-tryptophan and under the conditions tested, the pH optimum of the monatin formation reactions using the SEQ ID NO:220 polypeptide was found to be approximately pH 8.0 and the temperature optimum of the monatin formation reactions utilizing the SEQ ID NO:220 polypeptide was found to be approximately 25° C. These reactions have complex dynamics and the optimum reaction conditions for the full monatin production reaction may not be the same as the optimal conditions for individual reactions catalyzed by the DAT polypeptide.

Example 16

The Co-Expression of Chaperones to Increase the Soluble Expression of a DAT Polypeptide Because the soluble expression of the SEQ ID NO:894 DAT polypeptide was low using the standard expression protocols (either 1 mM IPTG in LB or Novagen Overnight Express Autoinduction System2, see Example 8), co-expression of the SEQ ID NO:894 polypeptide and a variety of commercially available chaperones was examined.
Chaperones:

The TaKaRa Chaperone Set (TAKARA BIO catalog #3340) consists of five different sets of chaperones developed by HSP Research Institute, Inc. They are designed to enable efficient expression of multiple molecular chaperones known to work in cooperation in the folding process. The set contained the following:

| Plasmid | Chaperone | Promoter | Inducer | Resistance Marker |
|---------|-----------|----------|---------|-------------------|
| pG-KJE8 | dnaK-dnaJ-grpE; groES-groEL | araB; Pztl | L-Arabinose; tetracycline | chloramphenicol |
| pGro7 | groES-groEL | araB | L-Arabinose | chloramphenicol |
| pKJE7 | dnaK-dnaJ-grpE | araB | L-Arabinose | chloramphenicol |
| pG-Tf2 | groES-groEL-tig | Pztl | Tetracycline | chloramphenicol |
| pTf16 | tig | araB | L-Arabinose | chloramphenicol |

Transformation Protocol

Chemically competent BL21 (DE3) cells (EMD Biosciences/Novagen catalog #69450) were transformed with 20 ng of one of the TaKaRa chaperone plasmids and 20 ng of SEQ ID NO:893/pET30a (encoding the SEQ ID NO:894 polypeptide; see Example C2 for the plasmid construction) by heat shock for 30 seconds at 42° C. The transformed cells were recovered in 0.5 mL of SOC medium for 1 hr at 37° C. and plated on LB plates containing 50 mg/L kanamycin and 25 mg/L chloramphenicol. The plates were incubated overnight at 37° C. Colonies were picked from the overnight plates and used to inoculate 5 mL of 2×YT medium containing 50 mg/L kanamycin and 25 mg/L chloramphenicol. After overnight incubation at 37° C., the plasmids were isolated from the cell pellets using a QUIAprep Spin Miniprep Kit (Qiagen catalog #27104). The plasmids were analyzed by restriction digestion with one-cutter enzymes from New England Biolabs (Beverly, Mass.) for both the chaperone plasmid and the SEQ ID NO:893/pET30a plasmid following the manufacture's recommended protocol.

| Plasmid | Restriction Enzyme |
|---------|--------------------|
| pG-KJE8 | XhoI |
| pGro7 | XbaI |
| pKJE7 | NheI |
| pG-Tf2 | XhoI |
| pTf16 | XbaI |

The isolated DNA containing both SEQ ID NO:893/pET30a and pKJE7 was digested with NheI and XbaI.

Expression Studies

Flasks of Novagen Overnight Express™ Autoinduction-System 2 (EMD Biosciences/Novagen catalog #71366) containing solutions 1-6, 50 mg/L kanamycin and 25 mg/L chloramphenicol (25 mL in each flask) were inoculated from fresh plates of the cells co-transformed with a chaperone plasmid and SEQ ID NO:893/pET30. At inoculation the inducers required for the chaperone plasmids were also added.

| Plasmid | Inducer concentration |
|---------|----------------------|
| pG-KJE8 | 2 mg/mL L-arabinose; 10 ng/mL tetracycline |
| pGro7 | 2 mg/mL L-arabinose |
| pKJE7 | 2 mg/mL L-arabinose |
| pG-Tf2 | 10 ng/mL tetracycline |
| pTf16 | 2 mg/mL L-arabinose |

The cells were incubated at 30° C. overnight and harvested by centrifugation when the OD at 600 nm reached 6 or greater. The cells were washed with cold 50 mM EPPS buffer (pH 8.4), centrifuged again, and either used immediately or frozen at −80° C.

Cell extracts were prepared by adding 5 mL per g of cell pellet of BugBuster® (primary amine-free) Extraction Reagent (EMD Biosciences/Novagen catalog #70923) with 5 μL/mL of Protease Inhibitor Cocktail II (EMD Bioscience/Calbiochem catalog #539132), 1 μl/mL of Benzonase® Nuclease (EMD Biosciences/Novagen catalog #70746), and 0.033 μl/mL of r-Lysozyme solution (EMD Biosciences/Novagen catalog #71110) to the cells. The cell suspensions were incubated at room temperature with gentle mixing for 15 min; spun at 14,000 rpm for 20 min (4° C.) and the supernatants carefully removed. Total protein concentrations were determined using the Pierce BCA protein assay kit (Pierce catalog #23225) with bovine serum albumin as the standard and a microtiter plate format. The expression of the D-aminotransferase was analyzed by SDS-PAGE using Bio-Rad Ready Gel® Precast 4-15% polyacrylamide gradient gels (Bio-Rad Laboratories catalog #161-1104). BioRad SDS-PAGE low range standards (catalog #161-0304) were run as standards on each gel. Aliquots of the cell extracts (15 μg protein) were mixed with protein loading buffer containing 2% SDS, 10% glycerol, 12.5% 2-mercaptoethanol, 0.1% bromophenol blue and 62.5 mM Tris-HCl (pH 8), incubated at 95° C. for 5 min, cooled and then loaded on the gel. In addition, the combined soluble and insoluble protein expression (total protein) was analyzed for each transformant. A 10 μl aliquot of each cell suspension before centrifugation was diluted in 90 μL protein loading buffer, incubated at 95° C. for 10 min, and cooled. Ten μl of each cooled solution was loaded on the gel.

The soluble protein gel showed that the best soluble expression of the polypeptide having the sequence of SEQ ID NO:894 occurred when chaperones GroEL-GroES (pGro7) were co-expressed.

The expression of the SEQ ID NO:894 polypeptide using an alternative plasmid in the presence of the GroEL-GroES chaperones was also examined. The SEQ ID NO:893 nucleic acid was subcloned into the pMET1a plasmid using the restriction enzymes NdeI and XhoI from New England Biolabs. This plasmid is a derivative of pET23a (EMD Biosciences/Novagen catalog #69745-3) and carries the metE gene (inserted at the NgoMIV site of the plasmid) and can complement the methionine auxotrophy of E. coli strains B834(DE3) and E. coli BW30384 (DE3) ompTmetE ("EE2D"). The construction of the "EE2D" strain is described in WO 2006/066072. The construction of an analogous plasmid to pMET1a that is a derivative of pET23d is described in the same PCT application.

The SEQ ID NO:893/pMET1a plasmid (25 ng) was transformed into "EE2D" electrocompetent cells singly or was co-transformed with pGro7 (20 ng) using the standard Bio-Rad electroporation protocol for E. coli cells with a Bio-Rad Gene Pulser II system (catalog #165-2111). The transformed cells were recovered in 0.5 mL of SOC medium for 1 h at 37° C. and plated on LB plates containing 100 mg/L ampicillin or on plates containing 100 mg/L ampicillin and 25 mg/L chloramphenicol (double plasmid transformants). The plates were incubated overnight at 37° C. One colony from each plate set was used to inoculate 50 mL of Novagen Overnight Express™ AutoinductionSystem 2 containing solutions 1-6, 100 mg/L ampicillin and 2 mg/mL L-arabinose. The culture inoculated with cells containing the pGro7 plasmid also contained 25 mg/L chloramphenicol. The cells were incubated at 30° C. overnight and harvested by centrifugation when the $OD_{600}$ reached 6 or greater. The cell pellets were washed with cold 50 mM EPPS buffer (pH 8.4), centrifuged again, and either used immediately or frozen at −80° C. Cell extracts were prepared as described above using the Novagen Bug-Buster® (primary amine-free) Extraction Reagent. The expression of soluble and total D-aminotransferase was analyzed by SDS-PAGE as described above.

The gel showed that expression of soluble SEQ ID NO:894 polypeptide was greater when the GroEL-GroES proteins were co-expressed. However, the soluble expression was not as high as with the pET30a construct described above.

The effect of incubation temperature during expression was also examined. A 5 mL culture of LB containing 100 mg/L ampicillin and 25 mg/L chloramphenicol was inoculated from a fresh plate of EE2D::SEQ ID NO:894PMET1a+pGro7. The culture was incubated overnight at 30° C. and then used to inoculate 3 flasks, each containing 50 mL of Novagen Overnight Express™ Autoinduction System 2 containing solutions 1-6, 100 mg/mL ampicillin, 25 mg/L chloramphenicol, and 2 mg/mL L-arabinose. One flask was incubated at 20° C., the second at 25° C. and the third at 30° C. The cells were harvested when the $OD_{600}$ reached 6 or greater. The cells were harvested and cell extracts were prepared as described above. Total protein concentrations were determined using the Pierce BCA protein assay kit (Pierce catalog #23225) with bovine serum albumin as the standard and a microtiter plate format. The expression of the D-aminotransferase was analyzed using the Bio-Rad Experion Pro260 Automated Electrophoresis Station following the manufacturer's protocol with the cell extract solutions diluted to 1 mg/mL. The results are shown in Table 32. It appears that the lowest temperature gave the maximum amount of expression of the SEQ ID NO:894 polypeptide.

TABLE 32

| Lane | Sample | Temp | Estimated DAT Expression |
|---|---|---|---|
| 1 | Pro260 Ladder | | |
| 2 | EE2D::23463pMET1 + pGRO7 cell extract | 20° C. | 23% |
| 3 | EE2D::23463pMET1 + pGRO7 cell extract | 25° C. | 21% |
| 4 | EE2D::23463pMET1 + pGRO7 cell extract | 30° C. | 19% |

Activity Assay Protocol

The enzymatic activity of the SEQ ID NO:894 DAT co-expressed with the GroEL-GroES chaperones was tested following the standard monatin reaction protocol. Briefly, each assay tube contained the following (in a total of 2 mL): 0.050 mg/mL aldolase in cell extract (assuming 20% soluble expression); 1.0 mg/mL D-aminotransferase in cell extract (assuming 20% soluble expression for an extract containing the SEQ ID NO:894 polypeptide) or purified *B. sphaericus* D-aminotransferase; 0.01% Tween-80; 200 mM sodium pyruvate; 100 mM D-tryptophan; 100 mM EPPS (pH 8.2); 1 mM $MgCl_2$; 0.05 mM PLP; and 10 mM potassium phosphate.

The reactions were incubated at room temperature in a Coy Laboratory Products, Inc. anaerobic chamber to minimize exposure to oxygen. All components except the enzymes were mixed together (the tryptophan did not completely dissolve until at least 1 h after the addition of the enzymes). The reactions were initiated by the addition of the enzymes. Samples were withdrawn at 1, 4, 8 and 22 h. A control reaction using 1 mg/mL purified *B. sphaericus* DAT was also run. The construction, expression and purification of this DAT are described in Example 6. The concentrations of the substrates and products were measured as described in Example 3.

The results are shown in Table 33. At 22 h, the concentration of monatin was 9.2 mM when the SEQ ID NO:894 polypeptide was present and 12.4 mM when the *B. sphaericus* enzyme was used. The concentration of the co-product HMG was significantly less when the SEQ ID NO:894 polypeptide was in the assay mixture (<⅓ the concentration when compared to the assay sample containing *B. sphaericus* enzyme). The HMG concentrations were evaluated by comparing the peak areas of the OPA derivatized samples.

TABLE 33

| Monatin Formation (mM) | | | | |
|---|---|---|---|---|
| Polypeptide (SEQ ID NO) | 1 h | 4 h | 8 h | 22 h |
| 894 DAT + GroEL-ES | 1.3 | 4.5 | 6.8 | 9.2 |
| *B. sphaericus* DAT | 1.6 | 5.7 | 8.3 | 12.4 |

Example 17

Use of ArcticExpress™ System to Increase the Soluble Expression of a DAT Polypeptide Because the soluble expression of the SEQ ID NO:894 polypeptide was low using the standard expression protocols (either 1 mM IPTG in LB or Novagen Overnight Express™ AutoinductionSystem 2—see Example 8), expression of the SEQ ID NO:893/pMET1a plasmid in the Stratagene ArcticExpress™ system was examined.

The Stratagene ArcticExpress™ system contains *E. coli* competent cells that carry the psychrophilic chaperones Cpn10 and Cpn60. These are chaperones isolated from the psychrophilic organism *Oleispira antarctica*. Cpn10 and Cpn60 show high sequence similarity to the *E. coli* chaperones GroEL and GroES, respectively, and have high protein folding activities at 4-12° C. The ArcticExpress™ host cells are derived from the *E. coli* BL21 strain. Not only do these cells lack the Lon protease, but they have been engineered to be deficient in OmpT protease as well.

Transformation Protocol

The plasmid SEQ ID NO:893/pMET1a (described in Example 16) was transformed into chemically competent ArcticExpress™ (DE3) cells (catalog #230192) following the manufacturer's protocol. The transformed cells were recovered in 0.5 mL of SOC medium for 1 h at 37° C. and plated on LB plates containing 100 mg/L ampicillin. The plates were incubated overnight at 37° C. and then stored at 4° C.

Expression Protocol

Colonies from the transformation plates were used to inoculate 5 mL of 2×YT medium containing 100 mg/L ampicillin and 10 mg/L gentamycin and incubated overnight at 30° C. Flasks of Novagen Overnight Express™ AutoinductionSystem 2 (EMD Biosciences/Novagen catalog #71366) containing solutions 1-6, with 100 mg/L ampicillin and 12 mg/L gentamycin were inoculated using the overnight cultures. After incubation at 30° C. for 6 h and the Overnight Express™ cultures were moved to either 15° C. or 20° C. or 25° C. incubators. The incubations were continued until the OD at 600 nm of the cultures reached 6 or greater. The cells were harvested by centrifugation, washed with cold 50 mM EPPS, pH 8.4, and the cell pellets were frozen at −80° C.

Cell extracts were prepared by adding 5 mL per g of cell pellet of BugBuster® (primary amine-free) Extraction Reagent (EMD Biosciences/Novagen catalog #70923) with 5 µL/mL of Protease Inhibitor Cocktail II (EMD Bioscience/Calbiochem catalog #539132), 1 µl/mL of Benzonase Nuclease (EMD Biosciences/Novagen catalog #70746), and 0.033 µl/mL of r-Lysozyme™ solution (EMD Biosciences/Novagen catalog #71110) to the cells. The cell suspensions were incubated at room temperature with gentle mixing for 15 min; spun at 14,000 rpm for 20 min (4° C.) and the supernatants were carefully removed. Total protein concentrations were determined using the Pierce BCA protein assay kit (Pierce catalog #23225) with bovine serum albumin as the standard and a microtiter plate format. The expression of the D-aminotransferase was analyzed using the Bio-Rad Experion Pro260 Automated Electrophoresis Station following the manufacturer's protocol with the cell extracts solutions diluted to 1 mg/mL.

The electrophoresis results show that the ArcticExpress™ system significantly increased the soluble expression of the SEQ ID NO:894 polypeptide when compared to the expression without chaperones or when co-expressed with the *E. coli* GroEL-GroES chaperones described in Example 16. The soluble expression was higher at lower temperatures, but still very high at 25° C.

| Lane | Sample | Incubation Temperature | Estimated DAT Expression |
|---|---|---|---|
| 1 | Pro260 Ladder | | |
| 2 | ArcticExpress(DE3)::894pMET1 cell extract | 15° C. | 58% |
| 3 | ArcticExpress(DE3)::894pMET1 cell extract | 20° C. | 46% |
| 4 | ArcticExpress(DE3)::894pMET1 cell extract | 25° C. | 47% |

Activity Assay Protocol:

The enzymatic activity of the SEQ ID NO:894 polypeptide expressed in the ArcticExpress™ system was tested by following monatin formation in the presence of the aldolase described in Example 6. Each assay tube contained the following (in a total of 2 mL): 0.010 mg/mL aldolase in cell extract (assuming 20% soluble expression); 1.0 or 2.0 mg/mL of the SEQ ID NO:894 polypeptide in cell extract (assuming 50% soluble expression for the extract containing the SEQ ID NO:894 polypeptide) or purified *B. sphaericus* D-aminotransferase; 0.01% Tween-80; 200 mM sodium pyruvate; 100 mM D-tryptophan; 100 mM EPPS, pH 8.2; 1 mM $MgCl_2$; 0.05 mM PLP; and 10 mM potassium phosphate.

The reactions were incubated at room temperature in a Coy Laboratory Products, Inc. anaerobic chamber to minimize exposure to oxygen. All components except the enzymes were mixed together (the tryptophan did not completely dissolve until at least 1 h after the addition of the enzymes). The reactions were initiated by the addition of the enzymes. Samples were withdrawn at 1, 4, 7 and 22 h. Control reactions using 1 or 2 mg/mL purified *B. sphaericus* D-aminotransferase were also run. The concentrations of the substrates and products were measured as described in Example 3. The results are shown in Table 34. At 22 h, the concentration of monatin was 8.2 mM when the SEQ ID NO:894 polypeptide was present at 1 mg/mL and 10.5 mM at 2 mg/mL DAT polypeptide. When the *B. sphaericus* enzyme was added at 1 mg/mL, the concentration of monatin at 22 h was 10.7 mg/mL; at 2 mg/mL, the monatin concentration was 14.5 mM. The stereopurity (as determined by the FDAA derivatization protocol in Example 3) of the product was >98% R,R with both enzymes and enzyme concentrations. The concentration of the co-product HMG was significantly less when the SEQ ID NO:894 polypeptide was used (~⅓ the concentration when compared to the assay samples containing *B. sphaericus* enzyme at either enzyme concentration). The HMG concentrations were evaluated by comparing the peak areas of the OPA derivatized samples.

TABLE 34

| Polypeptide (SEQ ID NO) | Monatin Formation (mM) | | | |
| --- | --- | --- | --- | --- |
| | 1 h | 4 h | 7 h | 22 h |
| 894 DAT (1 mg/mL) | 0.9 | 2.3 | 3.6 | 8.3 |
| 894 DAT (2 mg/mL) | 1.4 | 3.7 | 6.3 | 10.5 |
| *B. sphaericus* DAT (1 mg/lmL) | 1.0 | 4.2 | 6.1 | 10.7 |
| *B. sphaericus* DAT (2 mg/lmL) | 1.5 | 6.7 | 8.2 | 14.5 |

Example 18

Use of Stratagene ArcticExpress™ System to Increase the Soluble Expression of DATs Transformation Protocol:

The plasmids SEQ ID NO:891/pET30a (encoding the SEQ ID NO:892 polypeptide), SEQ ID NO:873/pET30a (encoding the SEQ ID NO:874 polypeptide) and the *Clostridium beijerinckii* DAT (CbDAT) in pET30a were transformed into chemically competent Stratagene ArcticExpress™ (DE3) cells (catalog #230192) following the manufacturer's protocol. The cloning of these genes is described in Example 4 and assay results are in Example 9. The transformed cells were recovered in 0.5 mL of SOC medium for 1 h at 37° C. and plated on LB plates containing 100 mg/L ampicillin and 13 mg/L gentamycin. The plates were incubated at room temperature for 2 days and then stored at 4° C.

Expression Protocol:

Colonies from the transformation recovery plates were used to inoculate 5 mL of 2×YT medium containing 50 mg/L kanamycin and 13 mg/L gentamycin; the liquid cultures were incubated for 6 h at 30° C. Flasks of Novagen Overnight Express™ AutoinductionSystem 2 (EMD Biosciences/Novagen catalog #71366) containing solutions 1-6, with 100 mg/L ampicillin and 13 mg/L gentamycin were inoculated from the 5 mL cultures. After incubation at 30° C. for 5-6 h, the cultures were moved to a 15° C. incubator. The 15° C. incubations were continued until the $OD_{600}$ of the cultures reached 6 or greater. The cells were harvested by centrifugation, washed with cold 50 mM EPPS, pH 8.4, and then the cell pellets were frozen at −80° C.

Cell extracts were prepared by adding 5 mL per g of cell pellet of BugBuster (primary amine-free) Extraction Reagent (EMD Biosciences/Novagen catalog #70923) with 5 µL/mL of Protease Inhibitor Cocktail II (EMD Bioscience/Calbiochem catalog #539132), 1 µl/mL of Benzonase Nuclease (EMD Biosciences/Novagen catalog #70746), and 0.033 µl/mL of r-Lysozyme™ solution (EMD Biosciences/Novagen catalog #71110) to the cells. The cell suspensions were incubated at room temperature with gentle mixing for 15 min; spun at 14,000 rpm for 20 min (4° C.) and the supernatants were carefully removed. Total protein concentrations were determined using the Pierce BCA protein assay kit (Pierce catalog #23225) with bovine serum albumin as the standard and a microtiter plate format. The expression of the DAT was analyzed using the Bio-Rad Experion Pro260 Automated Electrophoresis Station following the manufacturer's protocol with the cell extracts solutions diluted to 1 mg/mL. The results are shown in Tables 35 and 36.

The electrophoresis results show that the SEQ ID NO:874 polypeptide expressed in a soluble form slightly better than the SEQ ID NO:892 polypeptide using the ArcticExpress™ system. The soluble expression of the Cb DAT varied depending on the colony picked in the transformation plate. None of these DAT polypeptides expressed in a soluble form using the ArcticExpress™ system as well as the SEQ ID NO:894 polypeptide described in Example 16 was expressed.

TABLE 35

| Lane | Sample | Incubation Temperature | Estimated DAT Expression |
| --- | --- | --- | --- |
| 1 | Pro260 Ladder | | |
| 2 | ArcticExpress(DE3)::891/pET30a cell extract (colony #1) | 15° C. | 11% |
| 3 | ArcticExpress(DE3)::891/pET30a cell extract (colony #2) | 15° C. | 9% |
| 4 | ArcticExpress(DE3)::873/pET30a cell extract (colony #1) | 15° C. | 15% |
| 5 | ArcticExpress(DE3)::873/pET30a cell extract (colony #2) | 15° C. | 10% |
| 6 | ArcticExpress(DE3)::891/pET30a cell extract (colony #1) | 15° C. | 9% |
| 7 | ArcticExpress(DE3)::891/pET30a cell extract (colony #2) | 15° C. | 8% |
| 9 | ArcticExpress(DE3)::873/pET30a cell extract (colony #1) | 15° C. | 15% |
| 10 | ArcticExpress(DE3)::873/pET30a cell extract (colony #2) | 15° C. | 11% |

TABLE 36

| Lane | Sample | Incubation Temperature | Estimated DAT Expression |
|---|---|---|---|
| 1 | Pro260 Ladder | | |
| 2 | ArcticExpress(DE3)::CbDAT in pET30a cell extract (colony #1) | 15° C. | 9% |
| 3 | ArcticExpress(DE3)::CbDAT in pET30a cell extract (colony #2) | 15° C. | 19% |
| 4 | ArcticExpress(DE3)::CbDAT in pET30a cell extract (colony #3) | 15° C. | 13% |
| 5 | ArcticExpress(DE3)::CbDAT in pET30a cell extract (colony #4) | 15° C. | 4% |

Activity Assay Protocol

The enzymatic activity of the DAT polypeptides expressed in the ArcticExpress™ system were tested by following monatin formation in the presence of the aldolase described in Example 6. Each assay tube contained the following (in a total of 3 mL): 0.050 mg/mL aldolase in cell extract (estimating 20% soluble expression); 0.5 mg/mL DAT polypeptide in cell extract (estimating the soluble expression from the Experion data) or purified B. sphaericus DAT; 0.01 Tween-80; 200 mM sodium pyruvate; 100 mM D-tryptophan; 50 mM EPPS, pH 8.2; 1 mM $MgCl_2$; 0.05 mM PLP; and 10 mM potassium phosphate.

The reactions were incubated at room temperature in a Coy Laboratory Products, Inc. anaerobic chamber to minimize exposure to oxygen All components except the enzymes were mixed together (the tryptophan did not completely dissolve until at least 1 h after the addition of the enzymes). The reactions were initiated by the addition of the enzymes. Samples were withdrawn at 2, 4.5, 9 and 24 h. Control reactions with purified *B. sphaericus* D-aminotransferase were also run. The concentrations of the substrates and products were measured as described in Example 3. At 24 h, the assays containing the SEQ ID NO:892 or 894 polypeptide had produced approximately the same titer of monatin as the control *B. sphaericus* DAT reaction. The *C. beijerinckii* DAT reaction produced less than one-eighth of the monatin product, while the SEQ ID NO:874 polypeptide produced about half. The stereopurity of the product at 24 h (as determined by the FDAA derivatization protocol in Example 3) was 96% R,R monatin or greater for the SEQ ID NO:892 polypeptide. The concentration of the by-product HMG (4-hydroxy-4-methyl glutamic acid) was measured for the reactions with the SEQ ID NO:892, the SEQ ID NO:894 and the *B. sphaericus* DAT polypeptides. The assay with polypeptides having the sequence shown in SEQ ID NO:894 produced far less of the HMG by-product than the other two (about 20% of that produced by the assay containing the *B. sphaericus* DAT and about 40% of that produced by the assay with the SEQ ID NO:892 polypeptide). The HMG concentrations were estimated by comparing the peak areas of the OPA post-column derivatized samples.

TABLE 37

| Polypeptide (SEQ ID NO) | Monatin Formation (mM) 2 h | 4.5 h | 9 h | 24 h |
|---|---|---|---|---|
| *C. beijerinckii* DAT | 0.3 | 0.7 | 0.8 | 0.9 |
| 874 DAT | 1.8 | 3.2 | 4.1 | 4.4 |
| 892 DAT | 1.6 | 3.7 | 5.4 | 8.4 |
| 894 DAT | 1.4 | 2.8 | 4.5 | 8.4 |
| *B. sphaericus* DAT | 1.2 | 2.9 | 4.3 | 8.1 |

These results indicate that when expressed under the appropriate conditions, the polypeptides having the sequence of SEQ ID NO:892 and 894 can be utilized in reactions to produce highly pure R,R monatin at a titer as high as the positive control enzyme.

Example 19

Evaluation of Alternative Expression Hosts to Increase the Soluble Expression of a DAT Because the soluble expression of the SEQ ID NO:894 polypeptide was low when the nucleic acid was expressed in BL21(DE3) (see Example 8), alternative expression hosts were evaluated for improving soluble expression. The OverExpress™ C41(DE3) and C43(DE3) hosts contain genetic mutations phenotypically selected for conferring toxicity tolerance and express some toxic proteins at higher titers than other *E. coli* hosts.

Transformation Protocol

The plasmid SEQ ID NO:893/pET30a was transformed into electrocompetent cells of the OverExpress™ C41(DE3) and C43(DE3) (Lucigen catalog #60341 and 60345, respectively) using a Bio-Rad Gene Pulsar II system following the manufacturer's protocol. The transformation mixtures were recovered in 1 mL SOC medium for 1 hr at 37° C. and plated on LB plates containing 50 mg/L kanamycin. The plates were incubated overnight at 37° C. Multiple colonies were patched onto fresh plates and analyzed for the appropriate insert size using colony PCR. A small aliquot of cells was suspended in 0.025 mL $H_2O$ and incubated at 95° C. for 10 min. After cooling, 2 μL of each of the suspensions were used as the template in 0.025 mL reactions, each also containing 0.5 μL T7 promoter primer (0.1 mM), 0.5 μL T7 terminator primer (0.1 mM), 0.5 μL PCR Nucleotide Mix (Roche #12526720; 10 mM each nucleotide), 2.5 μL Roche Expand DNA polymerase buffer #2, and 0.5 μL Expand DNA polymerase (Roche Expand High Fidelity PCR System catalog #1732650). The 3-step thermocycler program was run for 25-30 cycles: 1 min at 94° C.; 1 min at 54° C., 1.3 min at 72° C. with a final polishing step of 7 min at 72° C.

Expression Studies

Flasks of Novagen Overnight Express™ Autoinduction-System 2 (EMD Biosciences/Novagen catalog #71366) containing solutions 1-6 and 50 mg/L kanamycin (40 mL in each flask) were inoculated from the patch plates of the transformed C41(DE3) and C43(DE3) cells (2 patches for each of the transformations). The cells were incubated at 30° C. overnight and harvested by centrifugation when the $OD_{600}$ reached 6 or greater. The cells were washed with cold buffer, were centrifuged again, and either used immediately or frozen at −80° C.

Cell extracts were prepared by adding 5 mL per g of cell pellet of BugBuster® (primary amine-free) Extraction Reagent (EMD Biosciences/Novagen catalog #70923) with 5 μL/mL of Protease Inhibitor Cocktail II (EMD Bioscience/Calbiochem catalog #539132), 1 μl/mL of Benzonase® Nuclease (EMD Biosciences/Novagen catalog #70746), and 0.033 μl/mL of r-Lysozyme™ solution (EMD Biosciences/Novagen catalog #71110) to the cells. The cell suspensions were incubated at room temperature with gentle mixing for 15 min; spun at 14,000 rpm for 20 min (4° C.) and the supernatants carefully removed. Total protein concentrations were determined using the Pierce BCA protein assay kit (Pierce catalog #23225) with bovine serum albumin as the standard and a microtiter plate format. The expression of the DAT polypeptide was analyzed by SDS-PAGE using Bio-Rad Ready Gel® Precast 4-15% polyacrylamide gradient gels (Bio-Rad Laboratories catalog #161-1104). BioRad SDS-PAGE low range standards (catalog #161-0304) were run as standards on each gel. Aliquots of the cell extracts (15 µg protein) were mixed with protein loading buffer containing 2% SDS, 10% glycerol, 12.5% 2-mercaptoethanol, 0.1% bromophenol blue and 62.5 mM Tris-HCl (pH 8), incubated at 95° C. for 5 min, cooled and then loaded on the gel. In addition, the combined soluble and insoluble protein expression (total protein) was analyzed for the transformants. A 10 µl aliquot of each cell suspension before centrifugation was diluted in 90 µL protein loading buffer, incubated at 95° C. for 10 min, and cooled. Ten µL of each cooled solution was loaded on the gel.

The electrophoresis gel shows that the protein expressed better in the C41(DE3) host than in the C43(DE3) host, however the apparent soluble expression was not higher than when BL21(DE3) cells were used.

Example 20

Evaluation of Low Temperature Expression to Increase the Soluble Expression of DAT Because the soluble expression of SEQ ID NO:894 D-aminotransferase was low when the gene was expressed in the *E. coli* strain BL21(DE3) (see Example 8), the gene was inserted in vectors with cold shock Protein A promoters to evaluate low temperature expression.

The Takara pCold Expression Vectors are four different vectors that utilize the cold shock Protein A (cspA) promoter for expression of high purity, high yield recombinant protein in *E. coli*. These vectors selectively induce target protein synthesis at low temperatures (15° C.) where the synthesis of other proteins is suppressed and protease activity is decreased. In addition to the cspA promoter, all four vectors contain a lac operator (for control of expression), ampicillin resistance gene (amp'), ColE1 origin of replication, M13 IG fragment, and multiple cloning site (MCS). Three of the vectors also contain a translation enhancing element (TEE), a His-Tag sequence, and/or Factor Xa cleavage site.

Cloning Protocol

The SEQ ID NO:893 DAT nucleic acid from plasmid SEQ ID NO:893/pET30a (encoding the polypeptide having the sequence of SEQ ID NO:894) was subcloned into the Takara pCold vectors at the NdeI and XhoI sites of the pCOLDII (contains a TEE and a His-tag sequence), pCOLDIII (contains a TEE) and pCOLDIV vectors. The digested vector and insert bands were gel purified using a QIAquick Gel Extraction Kit (Qiagen catalog #28704) and ligated using a Roche Rapid DNA Ligation Kit (catalog #1635379) following the manufacturer's protocol. The ligation mixtures were transformed into Invitrogen OneShot TOP10 chemically competent cells (catalog #C404003) by heat shock at 42° C. After recovery in 500 µL SOC medium for 1 h at 37° C., the transformation mixtures were plated on LB plates containing 100 mg/L ampicillin and incubated at 37° C. overnight. Colonies were picked from the transformation plates and used to inoculate 5 mL cultures of LB containing 100 mg/mL ampicillin that were incubated overnight at 37° C. Plasmid DNA was purified from the 5 mL cultures using a QIAprep® Spin Miniprep Kit (Qiagen catalog #27104). The inserts were verified restriction digestion with NdeI and XhoI by sequencing (Agencourt Bioscience Corp, Beverly, Mass.).

The SEQ ID NO:894dat pCOLD plasmids were transformed into chemically competent Stratagene ArcticExpress™ (DE3) cells and Novagen BL21(DE3) cells following the manufacturers' protocols. The transformation mixtures were recovered in 0.5-1 mL SOC medium for 1 h at 37° C. and plated on LB plates containing 100 mg/mL ampicillin and 13 mg/L gentamycin (ArcticExpress™ (DE3)) or 100 mg/mL ampicillin (BL21(DE3)). The plates were incubated overnight at 37° C.

Expression Studies

Flasks of Novagen Overnight Express™ Autoinduction-System 2 (EMD Biosciences/Novagen catalog #71366) containing solutions 1-6 and 100 mg/L ampicillin and 13 mg/L gentamycin (ArcticExpress™ (DE3)) or 100 mg/mL ampicillin (BL21(DE3) were inoculated from the patch plates of the transformed cells (2 patches for each of the SEQ ID NO:893/pCOLDII, SEQ ID NO:893/pCOLDIII and SEQ ID NO:893/pCOLDIV transformations).

After incubation at 30° C. for 3-5 hr the cultures were moved to a 15° C. incubator. The 15° C. incubations were continued until the OD at 600 nm of the cultures reached 6 or greater. The cells were harvested by centrifugation, washed with cold buffer, and then the cell pellets were frozen at −80° C.

Cell extracts were prepared by adding 5 mL per g of cell pellet of BugBuster® (primary amine-free) Extraction Reagent (EMD Biosciences/Novagen catalog #70923) with 5 µL/mL of Protease Inhibitor Cocktail II (EMD Bioscience/Calbiochem catalog #539132), 1 µl/mL of Benzonase® Nuclease (EMD Biosciences/Novagen catalog #70746), and 0.033 µl/mL of r-Lysozyme™ solution (EMD Biosciences/Novagen catalog #71110) to the cells. The cell suspensions were incubated at room temperature with gentle mixing for 15 min; spun at 14,000 rpm for 20 min (4° C.) and the supernatants were carefully removed. Total protein concentrations were determined using the Pierce BCA protein assay kit (Pierce catalog #23225) with bovine serum albumin as the standard and a microtiter plate format. The expression of the D-aminotransferase was analyzed using the Bio-Rad Experion™ Pro260 Automated Electrophoresis Station following the manufacturer's protocol with the cell extract solutions diluted to 1 mg/mL. The results are shown in Tables 38 and 39.

TABLE 38

| Lane | Sample | Estimated % DAT Expression |
|---|---|---|
| L | Pro260 Ladder | |
| 1 | BL21(DE3)::SEQ ID NO: 893/pCOLDII#1 | 8.7 |
| 2 | BL21(DE3)::: SEQ ID NO: 893/pCOLDII#2 | 8.5 |
| 3 | ArcticExpress ™(DE3)::: SEQ ID NO: 893/pCOLDII#1 | 9.8 |
| 4 | ArcticExpress ™(DE3)::: SEQ ID NO: 893/pCOLDII#2 | 6.4 |

TABLE 39

| Lane | Sample | Estimated % DAT Expression |
|---|---|---|
| L | Pro260 Ladder | |
| 1 | BL21(DE3):: SEQ ID NO: 893/pCOLDIII#1 | 4.3 |
| 2 | BL21(DE3):: SEQ ID NO: 893/pCOLDIII#2 | 2.3 |
| 3 | BL21(DE3):: SEQ ID NO: 893/pCOLDIV#1 | 14.6 |
| 4 | BL21(DE3):: SEQ ID NO: 893/pCOLDIV#2 | 14.2 |
| 5 | BL21(DE3):: SEQ ID NO: 893/pCOLDIII#1 | 4.4 |
| 6 | BL21(DE3):: SEQ ID NO: 893/pCOLDIII#2 | 5.2 |
| 7 | BL21(DE3):: SEQ ID NO: 893/pCOLDIV#1 | 13.8 |
| 8 | BL21(DE3):: SEQ ID NO: 893/pCOLDIV#2 | 16.1 |
| 9 | BL21(DE3):: SEQ ID NO: 893/pCOLDIV#1 | 16.2 |
| 10 | BL21(DE3):: SEQ ID NO: 893/pCOLDIV#2 | 16.8 |

The Experion Pro260 results show that the SEQ ID NO:894 DAT protein expressed better when the nucleic acid was incorporated in the pCOLDIV vector than in either the pCOLDII or pCOLDIII vector. From the experiments shown above, the average expression level for SEQ ID NO:893/pCOLDII was about 8%, regardless of expression host used; the average expression level for SEQ ID NO:893/pCOLDIII was about 4%, while the average expression level for SEQ ID NO:893/pCOLDIV was ~15%. These expression levels are significantly less than those described in Examples 16 when the SEQ ID NO:893 nucleic acid was co-expressed with the GroEL-GroES chaperones and in Example 17 when the nucleic acid was expressed in the Stratagene ArcticExpress™ system.

Example 21

Codon Modification of a DAT

An attempt to improve the solubility of the SEQ ID NO:894 polypeptide expressed in *E. coli* was undertaken with the presumption that, slowing the rate of translation in *E. coli* would allow more time for proper folding of the SEQ ID NO:894 polypeptide, thereby giving a higher expression of soluble protein. A BLAST search (NCBI) of the SEQ ID NO:894 polypeptide sequence revealed that some of the most closely related public sequences were from *Clostridium* species, specifically *Clostridium beijerinckii*. Example 9 describes the results from cloning, expressing, and assaying the CbDAT and its use in monatin formation reactions. Specifically, expression was high in the total protein fraction but very low in the soluble protein fraction.

The codon usage tables of *C. beijerinckii* and *E. coli* K12 were compared. Several rarely used codons in *C. beijerinckii* were found to be highly abundant in *E. coli* K12 (Table 40). It is possible that these rare codons cause translational pauses in *C. beijerinckii*, whereas in an *E. coli* K12 host, there may not be a pause. In the SEQ ID NO:894 sequence, 4 doublets were identified in which tandem rare codons for *C. beijerinckii* had become "non-rare" (i.e. abundant) in *E. coli* K12. The goal was to change these codons into rare codons for expression in *E. coli* K12 host using the *E. coli* K12 codon usage table. Primers were designed to change these doublets. SEQ ID NO:893/pET30a (described in Example 4) was used as a template and mutation was carried out according to the Stratagene QuickChange kit instructions. The primers utilized to modify the SEQ ID NO:893 nucleic acid sequence are shown below, along with the native gene (the targeted doublet sequences are underlined).

TABLE 40

| Original Codons | Codon Usage (per thousand) | | Altered Codons | Codon Usage |
|---|---|---|---|---|
| | *C. beijerinckii* | *E. coli* | | *E. coli* |
| GCC | 3.7 | 25.6 | GCT | 15.3 |
| CTG | 1.4 | 52.9 | CTA | 3.9 |
| ACC | 2.5 | 23.5 | ACA | 7.0 |
| CGC | 0.8 | 22.0 | CGA | 3.5 |
| GCG | 2.9 | 33.8 | GCT | 15.3 |
| CCG | 1.1 | 23.3 | CCC | 5.4 |

```
native sequence
                                                            >SEQ ID NO: 893
ATGGACGCACTGGGATATTACAACGGAAAATGGGGGCCTCTGGACGAGATGACCGTGCCGATGAACGACAG

GGGTTGTTTCTTTGGGGACGGAGTGTACGACGCTACCATCGCCGCTAACGGAGTGATCTTTGCCCTGGACGAGCACA

TTGACCGGTTTTTAAACAGCGCAAAGCTCCTGGAAATAGAAATCGGTTTTACAAAAGAGGAATTAAAAAAAACTTTT

TTTGAAATGCACTCCAAAGTGGATAAAGGGGTGTACATGGTTTATTGGCAGGCGACTCGCGGAACAGGCCGTCGAAG

CCATGTATTTCCGGCAGGTCCCTCAAATCTCTGGATTATGATTAAGCCCAATCACGTCGACGATCTTTATAGAAAAA

TCAAGCTCATTACCATGGAAGATACCCGCTTCCTCCACTGCAACATCAAGACCCTTAACCTTATTCCCAATGTCATT

GCCTCCCAGCGGGCGCTGGAAGCGGGCTGCCACGAGGCGGTCTTTCACCGGGGTGAAACAGTAACCGAGTGCGCCCA

CAGCAATGTCCACATCATTAAAAACGGCAGGTTTATCACCCACCAGGCGGACAACCTAATCCTTCGGGGCATAGCCC

GTAGCCATTTATTGCAAGCCTGTATCAGGCTGAACATTCCATTTGACGAACGGGAATTTACCCTTTCGGAATTATTT

GACGCGGATGAGATTCTTGTGTCCAGCAGCGGCACACTCGGCCTTAGCGCCAATACAATTGATGGAAAAAACGTGGG

GGGAAAAGCGCCGGAACTGCTAAAAAAAATTCAGGGCGAAGTGTTGAGGGAATTTATCGAAGCGACAGGCTACACGC

CTGAGTGGAGCACAGTATAG

Primers for Doublet 1 mutant
                                                            (SEQ ID NO: 1074)
CTAACGGAGTGATCTTTGCTCTAGACGAGCACATTGAC (SEQ ID NO: 1075)
GTCAATGTGCTCGTCTAGAGCAAAGATCACTCCGTTAG
```

```
                                                            -continued
Primers for Doublet 2 mutant
                                                                                      (SEQ ID NO: 1076)
CATGGAAGATACACGATTCCTCCACTGCAACATCAAGAC (SEQ ID NO: 1077)
GTCTTGATGTTGCAGTGGAGGAATCGTGTATCTTCCATG Primers for Doublet 3 mutant
                                                                                      (SEQ ID NO: 1078)
ATTGCCTCCCAGCGGGCTCTAGAAGCGGGCTGCCACG (SEQ ID NO: 1079)
CGTGGCAGCCCGCTTCTAGAGCCCGCTGGGAGGCAAT Primers for Doublet 4 mutant
                                                                                      (SEQ ID NO: 1080)
GGGGGGAAAAGCTCCCGAACTGCTAAAAAAATTCAGG (SEQ ID NO: 1081)
CCTGAATTTTTTTTAGCAGGTCGGGAGCTTTTCCCCCC
```

Clones with the correctly altered sequence were transformed into BL21(DE3) host for enzyme expression assays. Enzyme expression was determined by growing the cells overnight in Overnight Express II and lysing the cells with BugBuster reagent followed by SDS PAGE analyses of crude cell extract and soluble protein.

It appeared that there was a slight improvement in soluble protein expression with codon changes to doublets 1, 2 and 3. Codon changes at doublet 4 were not beneficial for soluble protein expression. Codon changes for doublets 1, 2 and 3 were combined in pairs using the Stratagene QuickChange kit and the primers designed for the initial codon changes. Clones with the correctly altered sequence were transformed into BL21(DE3) host for enzyme expression assays. Enzyme expression was determined by growing the cells overnight in Overnight Express II and lysing the cells with BugBuster reagent followed by SDS PAGE analyses of crude cell extract and soluble protein. The combinations of mutations to doublets 1 and 2, 2 and 3 and 1 and 3 yielded soluble protein bands visible on an SDS-PAGE gel. However, there still appeared to be more protein in the total protein fractions.

Example 22

The Evaluation of Periplasmic Expression of a DAT Polypeptide

Because the soluble expression of the SEQ ID NO:894 polypeptide was low when the gene product was expressed as a cytoplasmic protein in the *E. coli* host BL21(DE3) (see Example 8), the gene was cloned into vectors to generate fusion proteins that should be exported into the periplasmic space. The periplasm provides conditions that promote proper folding and disulfide bond formation and may enhance the solubility and activity of certain target proteins.

Cloning into EMD Biosciences/Novagen pET26b allows production of the target protein with a periplasmic signal sequence. The signal sequence is cleaved by signal peptidase concomitant with export. The EMD Biosciences/Novagen pET39b and pET40b are designed for cloning and expression of target proteins fused with a 208 amino acid DsbA-Tag™ or 236 amino acid DsbC-Tag™. DsbA and DsbC are periplasmic enzymes that catalyze the formation and isomerization of disulfide bonds, respectively. The fusion proteins are typically localized in the periplasm.

Cloning Protocol

The SEQ ID NO:893 nucleic acid from plasmid SEQ ID NO:893/pET30a (described in Example 4) was cloned into the EMD Biosciences/Novagen pET26b (catalog #69862-3), pET39b (catalog #70090-3), and pET40b (catalog #70091-3) vectors at the EcoRI and NotI sites of the vectors. The DATs nucleic acid with a 5' EcoRI site and a 3' NotI site was generated using the amplification protocol described in Example 4 and the following primers:

```
                                                        (SEQ ID NO: 1082)
5'-CGCAGAATTCGGACGCACTGGGATATTACAAC-3'

(SEQ ID NO: 1083)
5'-GTTAGCGGCCGCCTATACTGTGCTCCACTCAG-3'
```

The restriction sites are in italics in the primer sequences. The resulting DNA product and the pET26b, pET39b and pET40b vectors were digested with EcoR1 and Not I (New England Biolabs) following the suggested manufacturer's protocol. The vector reaction mixtures were subsequently treated with Shrimp Alkaline Phosphatase (Roche catalog #1758250). The digested vector and insert bands were gel purified from a 1% agarose gel using a Qiagen QIAquick® Gel Extraction Kit (catalog #28704) and ligated using a Roche Rapid Ligation Kit (catalog #1635379) following the manufacturer's protocol. The ligation mixtures were transformed into Invitrogen OneShot® TOP10 chemically competent cells (catalog #C404003) by heat shock at 42° C. After recovery in 500 µL SOC medium for 1 h at 37° C., the transformation mixtures were plated on LB plates containing 50 mg/L kanamycin and incubated at 37° C. overnight. Colonies were picked from the transformation plates and used to inoculate 5 mL cultures of LB containing 50 mg/mL kanamycin that were incubated overnight at 37° C. Plasmid DNA was purified from the 5 mL cultures using a Qiagen QIAprep spin miniprep kit (catalog #27104). The nucleic acid sequences were verified by sequencing (Agencourt Bioscience Corp, Beverly, Mass.). Plasmids with the correct insert sequences were transformed into EMD Biosciences/Novagen BL21(DE3) chemically competent cells (catalog #69450) by heat shock as described above.

Expression Studies

Flasks of Novagen Overnight Express™ Autoinduction-System 2 (EMD Biosciences/Novagen catalog #71366) containing solutions 1-6 and 50 mg/L kanamycin (50 mL in each flask) were inoculated from fresh plates of BL21(DE3) cells carrying the SEQ ID NO:893 DAT nucleic acid (encoding the polypeptide of SEQ ID NO:894) in either pET26b, pET39b or pET40b. The cells were incubated at 30° C. overnight and harvested by centrifugation when the OD$_{600}$ reached 6 or greater. The cells were washed with cold buffer, were centrifuged again, and used immediately or the cell pellets were frozen at −80° C. Before harvesting, 2 mL culture aliquots were withdrawn from each flask for soluble and total protein (soluble and insoluble) expression analyses. Cell extracts were prepared as described in Example 16. Total protein samples were prepared by suspending a small amount of cell pellet in protein loading buffer containing 2% SDS, 10% glycerol, 12.5% 2-mercaptoethanol, 0.1% bromophenol blue and 62.5 mM Tris-HCl, pH 8, and incubating at 95° C. for 10 min.

The periplasmic cellular fractions were prepared from the remainder of the cells from each culture following the protocol described in the EMD Biosciences/Novagen pET System Manual. The resulting fractions were concentrated 30-fold using Amicon Ultracel 10 k centrifugal filter devices (Millipore catalog #UFC901024). Total protein concentrations of the cell extracts and the periplasmid fractions were determined using the Pierce BCA protein assay kit (Pierce catalog #23225) with Bovine Serum Albumin as the standard and a microtiter plate format. Fifteen µg protein samples of the cell extracts and 10 µg protein samples of the periplasmic fractions were analyzed by SDS-PAGE using Bio-Rad Ready Gel® Precast 4-15% polyacrylamide gradient gels (Bio-Rad Laboratories catalog #161-1104). In addition, the total protein samples were analyzed by SDS-PAGE. BioRad SDS-PAGE low range standards (catalog #161-0304) were run as standards on each gel.

Analysis of the total protein SDS-PAGE gel shows that proteins with the predicted molecular weights expressed using the Overnight Express™ AutoinductionSystem 2. However, analysis of the SDS-PAGE gel loaded with the cell extract fractions or with the periplasmic fractions suggests that these proteins did not express solubly nor were they exported into the periplasm.

Example 23

Production of Monatin from Indole-3-pyruvate

The maximum concentration of monatin obtained when D-tryptophan and pyruvic acid are the starting raw materials in the monatin formation assay described in Example 5 is limited by the solubility of tryptophan. In order to explore the potential of using an aldolase and the SEQ ID NO:220 DAT polypeptide (described in Example 14) in reaching higher monatin concentrations, the reaction starting with indole-3-pyruvatr (I3P) and pyruvate acid as raw materials were analyzed. In this case, it was also necessary to provide an amino donor such as D-alanine or both D-alanine and D-tryptophan.

The test was conducted using purified SEQ ID NO:220 DAT polypeptide (production and purification described in Example 15) and an aldolase (described in Example 6). The reaction was set up as follows (in a total of 1 mL): 200 mM Indole-3-pyruvate (I3P); 200 mM sodium pyruvate; 400 mM D-alanine; 100 mM EPPS, pH 8.0; 1 mM MgCl$_2$; 0.05 mM PLP; and 10 mM potassium phosphate.

Both enzymes were added in excess to facilitate conversion to monatin to minimize completion from non-enzymatic degradation reactions. The reactions were incubated at room temperature in a Coy Laboratory Products, Inc. anaerobic chamber to minimize exposure to oxygen All components except the enzymes were mixed together and the pH was adjusted to 8.0. The reactions were initiated by the addition of the enzymes (0.04 mg/mL aldolase as cell extract (assuming 20% expression) and 0.40 mg/mL purified SEQ ID NO:220 DAT polypeptide).

In some tests as indicated in the table below, D-tryptophan was also added at either 50 or 100 mM in addition to the D-alanine to act as amino donor and also to limit the amount of indole-3-pyruvate consumed in the formation of D-tryptophan. The monatin formation was measured after 18 hours using the LC/MS/MS methodology described in Example 3, and the results are presented in Table 41 below.

TABLE 41

Monatin Formation from I3P (mM)

| Reactant initial concentrations (mM) | Monatin concentration (mM) |
|---|---|
| 200 I3P; 200 pyr: 400 D-ala | 44.9 |
| 200 I3P; 200 pyr: 400 D-ala, 50 D-trp | 47.8 |
| 200 I3P; 200 pyr: 400 D-ala, 100 D-trp | 61.0 |

As shown above, the aminotransferase and aldolase enzymes were active at the higher reactant concentrations and a much higher monatin concentration was achieved.

At 18 h, while using 200 mM indole-3-pyruvate, 200 mM sodium pyruvate and 100 mM D-tryptophan, the concentration of monatin was 61 mM. A small increase in monatin production (47.8 mM) was observed under the conditions of the assay, with the addition of 50 mM D-tryptophan vs. just using 400 mM D-alanine.

Example 24

Homology Table

Table 42 shows some of the most active DAT polypeptides and the corresponding closest homologs from the published databases or literature.

TABLE 42

| DAT polypeptide (SEQ ID NO) | Closest Hit from Database | % Sequence Identity |
|---|---|---|
| 896 | Bacillus sp. YM-1 | 76 |
| 874 | Serine glyoxylate transaminase from Acidiphilium cryptum JF-5 (NR Accession No: 148260372) | 51 |
| 878 | Putative glutamate-1-semialdehyde 2,1-aminomutase from Planctomyces maris DSM 8797 (NR Accession No. 149173540) | 43 |
| 882 | D-alanine transaminase from Oceanobacter sp. RED65 (NR Accession No: 94500389) | 57 |
| 910 | DAT from B. macerans | 91 |
| 176 | D-amino acid aminotransferase from Clostridium beijerincki (NCIMB 8052) | 62 |
| 220 | D-amino acid aminotransferase from Clostridium beijerincki (NCIMB 8052) | 62 |
| 156 | Aminotransferase class-III (leadered) from Chloroflexus aggregans DSM 9485 (NR Accession No: 118045454) | 46 |
| 214 | D-amino acid aminotransferase from Clostridium beijerincki (NCIMB 8052) | 61 |
| 918 | Aminotransferase class IV from Robiginitalea biformata HTCC2501 (NR Accession No: 88806011) | 57 |
| 902 | Putative glutamate-1-semialdehyde 2;1-aminomutase from Planctomyces maris DSM 8797 (same protein as above) | 46 |

TABLE 42-continued

| DAT polypeptide (SEQ ID NO) | Closest Hit from Database | % Sequence Identity |
|---|---|---|
| 884 | D-alanine transaminase from *Thiobacillus denitrificans* ATCC 25259 (NR Accession No: 74316285) | 40 |
| 866 | D-alanine aminotransferase from *Lactobacillus salivarius* subsp. *salivarius* UCC118 | 49 |
| 946 | D-amino acid aminotransferase from *Clostridium beijerincki* (NCIMB 8052) | 63 |

As shown in Example 9, homologs of the polypeptides having the sequence shown in SEQ ID NO:866, 946, 220, and 176 were cloned and also had activity in the production of R,R monatin, despite a sequence identity among those polypeptides of between 49% and 63%. Similarly, the predicted D-alanine transaminase from *Oceanobacter* species and the *Robinginitalea biformata* aminotransferase are expected to have broad D-amino acid aminotransferase activity like the DAT polypeptides having the sequence of SEQ ID NO:882 and 918.

Appendix I shows a table that describes selected characteristics of exemplary nucleic acids and polypeptides of the invention, including sequence identity comparison of the exemplary sequences to public databases. By way of example and to further aid in understanding Appendix I, the first row, labeled "SEQ ID NO:", the numbers "1, 2" represent the exemplary polypeptide of the invention having a sequence as set forth in SEQ ID NO:2, encoded by, e.g., SEQ ID NO:1. The sequences described in Appendix I (the exemplary sequences of the invention) have been subject to a BLAST search (as described herein) against two sets of databases. The first database set is available through NCBI (National Center for Biotechnology Information). The results from searches against these databases are found in the columns entitled "NR Description", "NR Accession Code", "NR E-value" or "NR Organism". "NR" refers to the Non-Redundant nucleotide database maintained by NCBI. This database is a composite of GenBank, GenBank updates, and EMBL updates. The entries in the column "NR Description" refer to the definition line in any given NCBI record, which includes a description of the sequence, such as the source organism, gene name/protein name, or some description of the function of the sequence. The entries in the column "NR Accession Code" refer to the unique identifier given to a sequence record. The entries in the column "NR E-value" refer to the Expected value (E-value), which represents the probability that an alignment score as good as the one found between the query sequence (the sequences of the invention) and that particular database sequence would be found in the same number of comparisons between random sequences as was done in the present BLAST search. The entries in the column "NR Organism" refer to the source organism of the sequence identified as the closest BLAST hit.

The second database set is collectively known as the GENESEQ™ database, which is available through Thomson Derwent (Philadelphia, Pa.). The results from searches against this database are found in the columns entitled "GENESEQ Protein Description", "GENESEQ Protein Accession Code", "E-value", "GENESEQ DNA Description", "GENESEQ DNA Accession Code" or "E-value". The information found in these columns is comparable to the information found in the NR columns described above, except that it was derived from BLAST searches against the GENESEQ™ database instead of the NCBI databases.

In addition, this table includes the column "Predicted EC No.". An EC number is the number assigned to a type of enzyme according to a scheme of standardized enzyme nomenclature developed by the Enzyme Commission of the Nomenclature Committee of the International Union of Biochemistry and Molecular Biology (IUBMB). The results in the "Predicted EC No." column are determined by a BLAST search against the Kegg (Kyoto Encyclopedia of Genes and Genomes) database. If the top BLAST match has an E-value equal to or less than e-6, the EC number assigned to the top match is entered into the table. The columns "Query DNA Length" and "Query Protein Length" refer to the number of nucleotides or the number amino acids, respectively, in the sequence of the invention that was searched or queried against either the NCBI or GENESEQ™ databases. The columns "Subject DNA Length" and "Subject Protein Length" refer to the number of nucleotides or the number amino acids, respectively, in the sequence of the top match from the BLAST searches. The results provided in these columns are from the search that returned the lower E-value, either from the NCBI databases or the GENESEQ™ database. The columns "% ID Protein" and "% ID DNA" refer to the percent sequence identity between the sequence of the invention and the sequence of the top BLAST match. The results provided in these columns are from the search that returned the lower E-value, either from the NCBI databases or the GENESEQ™ database.

Part C

Example 25

Construction and Testing of GSSM$^{SM}$ Mutants

This example describes the construction of exemplary nucleic acids and polypeptides, and describes their enzymatic activity. The nucleotide sequence (SEQ ID NO:219) was subcloned into pSE420-C-His vector and expressed in *E. coli* XL1-BLUE host (Stratagene, La Jolla, Calif.) to produce the exemplary D-aminotransferase (DAT) enzyme having the amino acid sequence shown in SEQ ID NO:220. The pSE420-C-His vector was created by adding a C-terminal His-tag to the pSE420 vector from Invitrogen (Carlsbad, Calif.). Construct SEQ ID NO:220 (in *E. coli* XL1-BLUE), was used as a starting sequence into which modifications were introduced and is referred to herein as the wild type (WT) sequence. A first round of modification (i.e., single-residue mutations) was performed using Gene Site Saturated Mutagenesis$^{SM}$ (GSSM$^{SM}$) technology (see, for example, U.S. Pat. No. 6,171,820). The mutants made using GSSM$^{SM}$ technology were expressed in the pSE420-C-His vector in *E. coli* host XL1-BLUE, arrayed into 384-well plates and grown at 37° C. overnight. Samples were subcultured and grown at 30° C. for two nights (36-48 hours). Cultures were frozen at −20° C. until cell lysates could be prepared.

Cells were lysed by addition of 10 μL of BPER II (Thermo Scientific, Rockford, Ill.) to each well. Samples were mixed three times and lysed on ice for one hour. Crude lysates were then assayed in the primary screen. 25 μL of crude lysate was assayed with 1 mM R,R-monatin, 25 mM pyruvic acid sodium salt, 0.08 mM PLP in 50 mM sodium phosphate (pH 8) at room temperature. After three hours, an aliquot was taken and formic acid was added to a final concentration of 2%. Samples were diluted with water to be within the range of the standard curve. Samples were analyzed for monatin consumption and alanine formation using the LC/MS/MS methods described in Example 1 (LC/MS/MS Method for Detecting D-alanine or R,R-monatin). Sample performance was compared to the performance of the wild type control (i.e., SEQ ID NO:220).

Mutants that outperformed the wild type control were selected as hits from the GSSM$^{SM}$ primary screen. Glycerol stocks of the primary hits were used to inoculate new 384-well plates. The hits were arrayed in quadruplicate, grown and lysed as indicated for the primary screen. The primary hits were then tested in a secondary screen. The secondary screen method was the same as for the primary screen except the mutants were tested with 1 mM and 15 mM R,R-monatin substrate. Samples were analyzed for monatin consumption and alanine formation using LC/MS/MS. Sample performance was compared to the performance of the wild type control.

Sample performance was evaluated using a scoring system based on alanine production and monatin consumption. The maximum score for a single sample was six. A maximum of three points were assigned for alanine production and a maximum of three points were assigned for monatin consumption. The scoring criteria were as follows: 1 point assigned for a value between average and one standard deviation of the positive control; 2 points assigned for a value between one and two standard deviations of the positive control; and 3 points assigned for a value beyond two standard deviations of the positive control.

The highest potential total score for a mutant was 48 (since the samples were screened in quadruplicate at 1 and 15 mM monatin). In general, mutants scoring 20 points or more were selected as secondary hits. However, some exceptions were made for samples scoring less than 20 points. Samples with alanine formation and monatin consumption values on the verge of the threshold requirements were also selected as hits. This prevented the premature elimination of hits and allowed for further testing and characterization in the tertiary screen.

Samples identified as secondary screen hits, using the criteria above, are listed in Table 43. Secondary hits were streaked from glycerol stocks onto LB agar plates containing 100 μg/mL carbenicillin and grown overnight at 37° C. Single colonies were used to inoculate 1 mL LB containing carbenicillin (100 μg/mL). Cultures were grown overnight at 37° C. DNA was isolated from the cultures, and then prepared and sequenced using 3730XL automated sequencers (Applied Biosystems, Foster City, Calif.).

Mutations and the amino acid position of the mutation for secondary hits are listed below in Table 43. Numbering of the amino acid positions starts with the N-terminal methionine. For example, the first mutation listed "Y6L" refers to changing the tyrosine in amino acid position 6 of the wild type enzyme (SEQ ID NO:220) to leucine. At the nucleic acid level, any codon which codes for the desired (mutated) amino acid can be used.

All of the amino acid sequences described in Tables 43, 44 and 50, below, are exemplary polypeptides; also provided are nucleic acid sequences that encode such polypeptides.

Example 26

List of GSSM$^{SM}$ Mutations

TABLE 43

GSSM$^{SM}$ Mutants Identified as Secondary Screen Hits

| Mutant name | Mutation |
| --- | --- |
| 1 | Y6L |
| 2 | Y6C; SILENT MUTATION AT AA31 (GGC → GGT) |
| 3 | Y6F |
| 4 | Y6L |

TABLE 43-continued

GSSM$^{SM}$ Mutants Identified as Secondary Screen Hits

| Mutant name | Mutation |
| --- | --- |
| 5 | Y6H |
| 6 | Y6L |
| 7 | Y6M |
| 8 | N10S |
| 9 | N10W |
| 10 | N10T |
| 11 | N10R |
| 12 | N10T |
| 13 | L14V |
| 14 | L14L |
| 15 | G41G |
| 16 | T18W |
| 17 | N40N |
| 18 | V19T |
| 19 | V42V |
| 20 | I62C |
| 21 | V82A |
| 22 | A57M |
| 23 | V42M |
| 24 | G41Y |
| 25 | A45L |
| 26 | V93Y |
| 27 | V93G |
| 28 | L46A |
| 29 | L46H |
| 30 | G98A |
| 31 | P20S |
| 32 | V93A |
| 33 | V103T |
| 34 | P108F |
| 35 | V93L |
| 36 | S101S |
| 37 | A106G |
| 38 | S101Q |
| 39 | P108T |
| 40 | N118G |
| 41 | P108C |
| 42 | I120L |

TABLE 43-continued

GSSM^SM Mutants Identified as Secondary Screen Hits

| Mutant name | Mutation |
|---|---|
| 43 | A106W |
| 44 | N118R |
| 45 | N110A; N118G |
| 46 | N118A |
| 47 | N118R |
| 48 | P117W; N118K |
| 49 | D133N |
| 50 | K126Q |
| 51 | K126R |
| 52 | K128S |
| 53 | I127M |
| 54 | T131T |
| 55 | D133L |
| 56 | M132A |
| 57 | D133E |
| 58 | L129V |
| 59 | K126K |
| 60 | I130M |
| 61 | M132Y |
| 62 | K128R |
| 63 | M132R |
| 64 | L129I |
| 65 | K128L; D2D (GAC → GAT) |
| 66 | F137W |
| 67 | I152V |
| 68 | N55L |
| 69 | N150S |
| 70 | L138L |
| 71 | P149P |
| 72 | G161G |
| 73 | A165T |
| 74 | H163R |
| 75 | H163K |
| 76 | H168A |
| 77 | E171S |
| 78 | E171R |
| 79 | E171R |
| 80 | T172I |
| 81 | C176G |
| 82 | A177S |
| 83 | A177S |
| 84 | S80L; R156W |
| 85 | H182G |
| 86 | N186S |
| 87 | K185R |
| 88 | K185T |
| 89 | D2H |
| 90 | D2T; E260G |
| 91 | D2Y |
| 92 | D2G |
| 93 | D2Q |
| 94 | D2F |
| 95 | D2A |
| 96 | D2T |
| 97 | D2N |
| 98 | D2R |
| 99 | D2I |
| 100 | D2V; G9A |
| 101 | G12A |
| 102 | D47W |
| 103 | S56S |
| 104 | I64H |
| 105 | L66L |
| 106 | I64C |
| 107 | L66G |
| 108 | E69Y |
| 109 | T74L |
| 110 | K73L |
| 111 | T74V |
| 112 | T74M |
| 113 | T74R |
| 114 | T74A |
| 115 | N76C |
| 116 | E77R |
| 117 | R156A |
| 118 | K72M |

TABLE 43-continued
GSSM^SM Mutants Identified as Secondary Screen Hits

| Mutant name | Mutation |
|---|---|
| 119 | S205A |
| 120 | Q209S |
| 121 | V212E |
| 122 | R213W |
| 123 | I216T |
| 124 | P217H |
| 125 | P217V |
| 126 | D219F |
| 127 | E220V |
| 128 | R221E |
| 129 | F223C |
| 130 | S226P |
| 131 | L228F |
| 132 | V234A |
| 133 | S238S |
| 134 | V236T |
| 135 | V236T |
| 136 | T241R |
| 137 | L242F |
| 138 | T241R |
| 139 | T241C |
| 140 | E248F |
| 141 | D250E |
| 142 | K257V |
| 143 | G256K |
| 144 | E260G |
| 145 | L262R |
| 146 | K263M |
| 147 | D267G |
| 148 | D267R |
| 149 | I265L |
| 150 | E268S |
| 151 | L270S |
| 152 | L270G |
| 153 | L270W |
| 154 | R271S |
| 155 | I274W |
| 156 | G278S |
| 157 | Y279C |
| 158 | S284R |
| 159 | E282G |
| 160 | T280N |
| 161 | V286G |
| 162 | R285F |
| 163 | V286R |
| 164 | G240G |
| 165 | E61R |
| 166 | E61D |
| 167 | E61Y |
| 168 | G85G |
| 169 | G85D |
| 170 | S80R |
| 171 | Y79R |
| 172 | Y79V |
| 173 | W283V |
| 174 | W283E |
| 175 | W283A |
| 176 | W283S |
| 177 | W283G |
| 178 | W283A |
| 179 | W283R |
| 180 | W283T |
| 181 | P281W |
| 182* | V236T; T241R |

*Mutant 182 was created using site-directed mutagenesis, using Mutant 136 DNA as a template and then introducing the V236T mutation. One skilled in the art can synthesize this gene using site-directed mutagenesis techniques.

Samples listed in Table 43 were then prepared for the tertiary screen. Glycerol stocks were used to inoculate 5 mL of LB containing 100 µg/mL carbenicillin. Cultures were grown overnight at 37° C. The overnight cultures were then used to inoculate 50 mL cultures of LB containing 100 µg/mL carbenicillin in 250 mL baffled flasks to $OD_{600nm}$ of 0.05. IPTG was added to a final concentration of 1 mM when the $OD_{600nm}$ reached 0.4-0.8. Cultures were induced overnight at 30° C. Cell pellets were harvested by centrifugation at 6,000 rpm for 20 minutes. Cell pellets were frozen at −20° C. until cell lysates could be prepared. Cells were lysed with BPER II (Thermo Scientific, Rockford, Ill.) on ice for 1 hour. Clarified lysates were prepared by centrifugation at 12,000 rpm for 30 minutes.

Protein was quantified by Bio-Rad Bradford Protein Assay (Bio-Rad, Hercules, Calif.) per the manufacturer's instructions. SDS-PAGE analysis and densitometry were used to determine the amount of expressed D-aminotransferase. Samples were normalized for expressed D-aminotransferase. 0.02 mg/mL D-aminotransferase was tested in the tertiary screen. The tertiary screening method was the same as the secondary screening method except that samples were taken at 0, 5, 10, 15, 30, 60, 120 and 210 minutes to develop a timecourse. Alanine production and monatin consumption values were measured by LC/MS/MS analysis and compared to a standard curve. Samples were compared to the wild type control.

Samples with higher final titers or faster initial rates than the wild type control were identified as hits and are referred to as upmutants. The GSSM$^{SM}$ upmutants identified in the tertiary screen are listed in Table 44. These upmutants are further described in Example 27 below.

Example 27

Enzymatic Activity of Polypeptides Upmutants

This example describes data demonstrating the enzymatic activity of exemplary upmutant polypeptides disclosed herein, e.g., the polypeptides having amino acid sequences described in Table 44. Table 44 shows the activity of the upmutants relative to the wild type control at the 15 minute time point in reactions using 1 mM and 15 mM R,R-Monatin substrate. Relative activity is the amount of alanine produced by the sample divided by the amount of alanine produced by the wild type control.

TABLE 44

Activity of GSSM Upmutants in Tertiary Screen

| Mutant | Mutation | Activity relative to wild type control (SEQ ID NO: 220) | |
|---|---|---|---|
| | | Reaction with 1 mM monatin substrate | Reaction with 15 mM monatin substrate |
| 23 | V42M | 1.28 | 1.04 |
| 24 | G41Y | 1.37 | 1.31 |
| 27 | V93G | 1.73 | 1.98 |
| 31 | P20S | 1.29 | 1.60 |
| 35 | V93L | 1.14 | 0.96 |
| 40 | N118G | 2.61 | 1.52 |
| 44 | N118R | 1.55 | 0.47 |
| 45 | N110A; N118G | 2.50 | 2.02 |
| 46 | N118A | 2.28 | 0.69 |
| 48 | P117W; N118K | 2.54 | 1.12 |
| 58 | L129V | 1.04 | 0.85 |
| 66 | F137W | 1.25 | 1.44 |
| 67 | I152V | 1.19 | 1.24 |
| 81 | C176G | 1.11 | 1.27 |
| 82 | A177S | 1.24 | 1.02 |
| 104 | I64H | 1.37 | 1.07 |
| 109 | T74L | 1.37 | 1.31 |
| 110 | K73L | 2.83 | 3.75 |
| 111 | T74V | 1.99 | 2.19 |
| 112 | T74M | 1.78 | 2.01 |
| 135 | V236T | 3.44 | 2.88 |
| 136 | T241R | 2.64 | 1.79 |
| 152 | L270G | 1.24 | 0.89 |
| 153 | L270W | 2.00 | 1.54 |
| 174 | W283E | 1.23 | 0.84 |
| 175 | W283A | 1.61 | 1.09 |
| 177 | W283G | 1.71 | 1.06 |
| 6 | Y6L | 2.52 | 2.21 |
| 88 | K185T | 1.04 | 0.95 |
| 107 | L66G | 1.08 | 1.02 |

Several samples were identified that outperformed the wild type control under the conditions tested. Potential $K_m$ and $V_{max}$ upmutants were identified. These results indicate that the wild type control (SEQ ID NO:220) is further evolvable for increased specific D-aminotransferase activity on monatin.

Example 28

Activity of GSSM$^{SM}$ Mutants in Monatin Process

Analysis of GSSM DATs in pSE420-C-His

This example describes data demonstrating the enzymatic activity of exemplary polypeptides disclosed herein. Mutant 27, Mutant 44, Mutant 58, Mutant 119, Mutant 135, Mutant 136, Mutant 152, Mutant 154 and the wild type control (in vector pSE420-C-His in E. coli XL1-Blue, as described in Examples 25 and 26) were streaked onto agar plates containing LB medium with ampicillin (100 µg/mL). Single colonies were used to inoculate 5 mL of LB medium containing ampicillin (100 µg/mL). Five hundred µl were used to inoculate 50 mL of the same medium in a 250 mL baffled flask. The cells were grown at 30° C. to approximately an $OD_{600nm}$ of 0.4. IPTG was added to a final concentration of 1 mM. Cells were grown at 30° C. for 4 hours and collected by centrifugation. Cells were immediately frozen at −80° C. until cell extracts were prepared.

Cell extracts were prepared as described in Example 4. Protein concentrations were determined using the BCA (Pierce, Rockford, Ill.) microtiter plate assay with BSA (Pierce Rockford, Ill.) as the standard, per the manufacturer's instructions. To estimate the concentration of the D-aminotransferase in the cell-free extracts, SDS-PAGE analysis was done and visual estimation was used to estimate percentage of expression. The DAT proteins were soluble in the range of 10-25% expression as percentage of total protein and this was used to calculate the dosage of the assays.

An R,R monatin formation assay was performed containing 100 mM EPPS buffer pH 7.8, 1 mM $MgCl^2$, 0.05 mM PLP, 200 mM sodium pyruvate, 10 mM potassium phosphate, 0.01% Tween-80 with 0.1 mg/mL aldolase and 0.2 mg/mL of DAT in a 4 mL reaction at room temperature. Mutant 27 used 0.15 mg/mL of DAT enzyme instead of 0.2 mg/mL. After 0.5, 1, 2, 4 and 23 hours, an aliquot was taken, formic acid was added to a final concentration of 2%, and the samples spun and filtered. Samples were analyzed for monatin using the LC/MS/MS methodology described in Example 36. Results are shown in Table 45.

TABLE 45

Activity of DATs (cloned into pSE420-C-His)

| DAT polypeptide | Monatin (mM) 0.5 hr | Monatin (mM) 1 hr | Monatin (mM) 2 hr | Monatin (mM) 4 hr |
|---|---|---|---|---|
| wild type control | 2.12 | 5.26 | 9.34 | 13.05 |
| Mutant 27 | 4.74 | 9.55 | 14.72 | 18.06 |
| Mutant 44 | 3.73 | 6.61 | 10.38 | 13.23 |
| Mutant 58 | 3.61 | 7.51 | 11.85 | 14.56 |
| Mutant 135 | 3.50 | 7.72 | 12.50 | 16.17 |
| Mutant 136 | 1.40 | 4.63 | 6.59 | — |
| Mutant 152 | 4.79 | 9.19 | 13.08 | 14.85 |
| Mutant 154 | 3.76 | 7.66 | 11.85 | 14.38 |

As can be seen from the data shown in Table 45, a number of DAT mutants obtained through GSSM$^{SM}$ evolution showed improved initial rates of monatin formation over the wild type control under the conditions of the assay.

Analysis of GSSM<sup>SM</sup> DATs in pMet1a

This example describes data demonstrating the enzymatic activity of exemplary polypeptides disclosed herein. Mutant 2, Mutant 6, Mutant 11, Mutant 27, Mutant 40, Mutant 44, Mutant 45, Mutant 58, Mutant 110, Mutant 135, and Mutant 136 were recreated by site directed mutagenesis using QuikChange Multi Site-Directed Mutagenesis Kit (Stratagene, La Jolla, Calif.) according to the manufacturer's instructions. To generate the mutants, the pMET1a tagged construct described in Example 16 (pMET1a:SEQ ID NO:220(WT)) was used as the template. The mutagenic primers used are listed below in Table 46. The PCR fragments were digested with Dpn1 (Invitrogen, Carlsbad, Calif.) for 1 hour and transformed into E. coli Top 10 cells (Invitrogen, Carlsbad, Calif.). The resultant purified plasmid preparations were sequenced (Agencourt, Beverly, Mass.) to verify that the correct mutations were incorporated. The plasmids were then transformed into E. coli B834(DE3) expression host (Novagen, San Diego, Calif.).

Mutant 2, Mutant 6, Mutant 27, Mutant 40, Mutant 45, Mutant 58, Mutant 110, Mutant 119, Mutant 131, Mutant 135, Mutant 136, Mutant 152, Mutant 154 were generated in the pMET1a vector and transformed into the compatible E. coli expression host B834(DE3) (Novagen, San Diego, Calif.) described in Example 2. Overnight cultures in LB medium containing carbenicillin (100 µg/mL) were diluted 1:100 in 100 mL of the same medium and grown in a 500 mL baffled flask. The culture was grown at 30° C. overnight to an $OD_{600nm}$ of 10 in Overnight Express II medium (Solution 1-6, Novagen). Samples for total protein were taken immediately prior to harvesting. Cells were harvested by centrifugation and washed once with 10 mL of potassium phosphate buffer pH 7.8. Cells were immediately frozen at −80° C. until cell extracts were prepared. It is noted that, in addition to site-directed mutagenesis, one skilled in the art can synthesize the genes encoding these D-aminotransferases using multi-change mutagenesis PCR techniques such as those described in Example 25.

TABLE 46

Primers for Mutagenesis

| Mutant produced | PCR primers | Template |
|---|---|---|
| Mutant 2 | 5'-ATG GAC GCA CTG GGA TGT TAC AAC GGA AAT TGG-3' (SEQ ID NO: 1084)<br>5'-CCA ATT TCC GTT GTA ACA TCC CAG TGC GTC CAT-3' (SEQ ID NO: 1085) | SEQ ID NO: 220 |
| Mutant 6 | 5'-ATG GAC GCA CTG GGA CTT TAC AAC GGA AAT TGG GGG-3' (SEQ ID NO: 1086)<br>5'-CCC CCA ATT TCC GTT GTA AAG TCC CAG TGC GTC CAT-3' (SEQ ID NO: 1087) | SEQ ID NO: 220 |
| Mutant 27 | 5'-TAC CTG GTT TAT TGG CAG GGT ACT CGC GGA ACA GGC CGG-3' (SEQ ID NO: 1088)<br>5'-CCG GCC TGT TCC GCG AGT ACC CTG CCA ATA AAC CAG GTA-3' (SEQ ID NO: 1089) | SEQ ID NO: 220 |
| Mutant 40 | 5'-CTC TGG ATT ATA ATT AAG CCC GGC CAC ATC GAC AAT CTT TAT AG-3' (SEQ ID NO: 1090)<br>5'-CTA TAA AGA TTG TCG ATG TGG CCG GGC TTA ATT ATA ATC CAG AG-3' (SEQ ID NO: 1091) | SEQ ID NO: 220 |
| Mutant 44 | 5'-CTC TGG ATT ATA ATT AAG CCC AGG CAC ATC GAC AAT CTT TAT AG-3' (SEQ ID NO: 1092)<br>5'-CTA TAA AGA TTG TCG ATG TGC CTG GGC TTA ATT ATA ATC CAG AG-3' (SEQ ID NO: 1093) | SEQ ID NO: 220 |
| Mutant 45 | 5'-GTA TTT CCG GCA GGC CCT TCA GCG CTC TGG ATT ATA ATT AAG CC-3' (SEQ ID NO: 1094)<br>5'-GGC TTA ATT ATA ATC CAG AGC GCT GAA GGG CCT GCC GGA AAT AC-3' (SEQ ID NO: 1095) | Mutant 40 |
| Mutant 58 | 5'-CAA TCT TTA TAG AAA AAT CAA GGT TAT TAC CAT GGA TGA TAC CCG C 3' (SEQ ID NO: 1096)<br>5'-GCG GGT ATG ATC CAT GGT AAT AAC CTT GAT TTT TCT ATA AAG ATT G-3' (SEQ ID NO: 1097) | SEQ ID NO: 220 |
| Mutant 110 | 5'-CTT AAC AAA AGA GGA ATT GAA ACT GAC TTT AAA TGA AAT GTA CTC C-3' (SEQ ID NO: 1098)<br>5'-GGA GTA CAT TTC ATT TAA AGT CAG TTT CAA TTC CTC TTT TGT TAA G-3' (SEQ ID NO: 1099) | SEQ ID NO: 220 |
| Mutant 135 | 5'-TTC GAC GCG GAC GAG GTG CTT ACT TCC AGC AGC GGC ACA CTC G-3' (SEQ ID NO: 1100)<br>5'-CGA GTG TGC CGC TGC TGG AAG TAA GCA CCT CGT CCG CGT CGA A-3' (SEQ ID NO: 1101) | SEQ ID NO: 220 |
| Mutant 136 | 5'-TGC TTG TGT CCA GCA GCG GCC GGC TCG GCC TTA GCG CCG-3' (SEQ ID NO: 1102)<br>5'-CGG CGC TAA GGC CGA GCC GGC CGC TGC TGG ACA CAA GCA-3' (SEQ ID NO: 1103) | SEQ ID NO: 220 |

Cell extracts were prepared and desalted as described in Example 4 using 100 mM potassium phosphate as the buffer to elute and equilibrate the PD10 column. Total protein and DAT concentrations were determined as described.

Transamination of R,R monatin with pyruvate as the amino acceptor were performed as described in Example 5 except that 15 mM R,R monatin was utilized. Initial analyses of alanine, monatin, and monatin precursor levels identified Mutant 40, Mutant 135 and Mutant 136 as superior mutants resulting in the highest levels of alanine production as shown in Table 47. DAT Mutant 136 appeared to have the highest activity for conversion of R,R monatin to R-MP. The alanine production numbers (in mM) for the various time points are shown in Table 47.

TABLE 47

Alanine formation (mM) from R,R monatin transamination reactions from DATs cloned into pMET1a

| DAT polypeptide | Alanine (mM) 15 minutes | Alanine (mM) 30 minutes | Alanine (mM) 60 minutes | Alanine (mM) 120 minutes |
|---|---|---|---|---|
| wild type control | 3.08 | 5.47 | 8.19 | 10.07 |
| Mutant 2 | 3.38 | 5.74 | 8.85 | 10.52 |
| Mutant 6 | 3.51 | 5.97 | 8.99 | 10.81 |
| Mutant 27 | 4.36 | 8.00 | 10.72 | 10.52 |
| Mutant 40 | 7.89 | 10.37 | 11.79 | 12.50 |
| Mutant 44 | 2.65 | 4.58 | 7.18 | — |
| Mutant 58 | 3.90 | 6.95 | 9.93 | 10.52 |
| Mutant 110 | 3.50 | 6.17 | 9.53 | 10.52 |
| Mutant 135 | 5.35 | 8.64 | 10.82 | 10.91 |
| Mutant 136 | 6.24 | 9.46 | 11.24 | 11.15 |
| Mutant 152 | 4.26 | 7.12 | 9.83 | 10.32 |
| Mutant 154 | 4.16 | 7.13 | 10.07 | 10.76 |

—: not determined under present conditions

To further assess activity, a monatin formation assay was done as described in Example 1 with a DAT concentration of approximately 0.2 mg/mL. As a control, 0.2 mg/mL concentration of purified wild type DAT was evaluated. After 0.5, 1, 2, and 4 hrs, an aliquot was taken and formic acid was added to a final concentration of 2%, and the samples were spun and filtered. Samples were analyzed for monatin using the LC/MS/MS methodology described herein and for tryptophan and alanine using the LC/OPA post-column fluorescence methodology described in Example 36.

TABLE 48

Activity of DATs in pMET1a

| DAT polypeptide | Monatin (mM) 0.50 hr | Monatin (mM) 1.00 hr | Monatin (mM) 2.00 hr | Monatin (mM) 4.00 hr |
|---|---|---|---|---|
| wild type control | 3.96 | 7.83 | 9.70 | 11.18 |
| Mutant 2 | 1.56 | 3.78 | 8.77 | 12.68 |
| Mutant 27 | 4.70 | 9.70 | n.d. | 13.80 |
| Mutant 44 | 3.03 | 5.61 | 8.50 | 12.28 |
| Mutant 45 | 1.40 | 4.00 | 7.70 | 11.50 |
| Mutant 58 | 3.83 | 7.23 | 11.33 | 14.12 |
| Mutant 110 | 2.60 | 5.90 | 9.90 | 12.70 |
| Mutant 119 | 4.12 | 7.87 | 11.37 | 13.50 |
| Mutant 131 | 3.75 | 7.41 | 11.40 | 13.90 |
| Mutant 135 | 6.39 | 10.65 | 13.49 | 13.15 |
| Mutant 136 | 3.36 | 8.02 | 12.86 | 13.16 |
| Mutant 154 | 3.00 | 6.06 | 10.67 | 13.17 |

All the DATs shown in Table 48 produced monatin. DAT mutants Mutant 58, Mutant 135 and Mutant 136 had faster initial rates than the wild type control. Mutant 136 was slower for reaction one (conversion of D-Trp to I3P) but had better overall monatin production than the wild type control.

For the final time point, an additional aliquot was taken (without the addition of formic acid) to determine the stereoisomeric distribution of the monatin produced using the FDAA derivatization methodology described in Example 36. For the select mutants tested, there was little to no impact on stereopurity. In all cases, the mutants produced over 98.8% R,R under the assay conditions tested. These results are shown in Table 49.

TABLE 49

Stereopurities of Monatin Produced by Select Mutants at 4 hours

| DAT polypeptide | % SS | % RS | % RR | % SR |
|---|---|---|---|---|
| wild type (pMet1a) control | 0.00 | 0.40 | 99.30 | 0.20 |
| Mutant 6 | 0.00 | 0.40 | 99.50 | 0.10 |
| Mutant 27 | 0.00 | 0.80 | 98.80 | 0.30 |
| Mutant 40 | 0.00 | 0.20 | 99.80 | 0.00 |
| Mutant 45 | 0.00 | 0.50 | 99.40 | 0.10 |
| Mutant 110 | 0.10 | 0.40 | 99.30 | 0.10 |
| Mutant 135 | 0.00 | 0.40 | 99.50 | 0.10 |
| Mutant 136 | 0.02 | 1.00 | 99.00 | 0.03 |

Example 29

Construction and Testing of Tailored Multi-Site Combinatorial Assembly (TMCA$^{SM}$) Mutants This example describes the construction of exemplary nucleic acids and polypeptides, and describes their enzymatic activity. A subset of GSSM mutations were selected for combination using Tailored Multi-Site Combinatorial Assembly$^{SM}$ (TMCA$^{SM}$) technology. The top ten performers from the GSSM evolution in either the 1 or 15 mM monatin reactions were selected for TMCA$^{SM}$ evolution. The wild type sequence (SEQ ID NO:220) was threaded onto a model of 3DAA-D amino acid aminotransferase (FIG. 4). The model in FIG. 4 is shown with pyridoxyl-5'-phosphate D-alanine, with the numbered residues indicating those sites selected for TMCA$^{SM}$ evolution. Table 50 also lists the mutations that were selected for inclusion in the TMCA$^{SM}$ library. TMCA$^{SM}$ evolution was performed on wild type (SEQ ID NO:220) and Mutant 45 using the methods described in PCT Application No. PCT/US08/071,771.

TMCA evolution is described in PCT Application Number PCT/US08/071,771 and comprises a method for producing a plurality of progeny polynucleotides having different combinations of various mutations at multiple sites. The method can be performed, in part, by a combination of at least one or more of the following steps:

Obtaining sequence information of a ("first" or "template") polynucleotide. For example, the first or template sequence can be a wild type (e.g. SEQ ID NO:220) or mutated (e.g. Mutant 45) sequence. The sequence information can be of the complete polynucleotide (e.g., a gene or an open reading frame) or of partial regions of interest, such as a sequence encoding a site for binding, binding-specificity, catalysis, or substrate-specificity.

Identifying three or more mutations of interest along the first or template polynucleotide sequence. For example, mutations can be at 3, 4, 5, 6, 8, 10, 12, 20 or more positions within the first or template sequence. The positions can be predetermined by absolute position or by the context of surrounding residues or homology. For TMCA of DAT polypeptides, the top 10 codon changes that resulted in improved enzyme performance were included as mutations of interest. The sequences flanking the mutation positions on either side can be known. Each mutation position may contain two or more mutations, such as for different amino acids. Such mutations can be identified by using Gene Site Saturation Mutagenesis$^{SM}$ (GSSM$^{SM}$) technology, as described herein and in U.S. Pat. Nos. 6,171,820; 6,562,594; and 6,764,835.

Providing primers (e.g., synthetic oligonucleotides) comprising the mutations of interest. In one embodiment, a primer is provided for each mutation of interest. Thus, a first or template polynucleotide having 3 mutations of interest can use 3 primers at that position. The primer also can be provided as a pool of primers containing a degenerate position so that the mutation of interest is the range of any nucleotide or naturally occurring amino acid, or a subset of that range. For example, a pool of primers can be provided that favor mutations for aliphatic amino acid residues.

The primers can be prepared as forward or reverse primers, or the primers can be prepared as at least one forward primer and at least one reverse primer. When mutations are positioned closely together, it can be convenient to use primers that contain mutations for more than one position or different combinations of mutations at multiple positions.

Providing a polynucleotide containing the template sequence. The first or template polynucleotide can be circular, or can be supercoiled, such as a plasmid or vector for cloning, sequencing or expression. The polynucleotide may be single-stranded ("ssDNA"), or can be double-stranded ("dsDNA"). For example, the TCMA method subjects the supercoiled ("sc") dsDNA template to a heating step at 95° C. for 1 min (see Levy, *Nucleic Acid Res.*, 28(12):e57(i-vii) (2000)).

Adding the primers to the template polynucleotide in a reaction mixture. The primers and the template polynucleotide are combined under conditions that allow the primers to anneal to the template polynucleotide. In one embodiment of the TMCA protocol, the primers are added to the polynucleotide in a single reaction mixture, but can be added in multiple reactions.

Performing a polymerase extension reaction. The extension products (e.g., as a "progeny" or "modified extended polynucleotide") may be amplified by conventional means. The products may be analyzed for length, sequence, desired nucleic acid properties, or expressed as polypeptides. Other analysis methods include in-situ hybridization, sequence screening or expression screening. The analysis can include one or more rounds of screening and selecting for a desired property.

The products can also be transformed into a cell or other expression system, such as a cell-free system. The cell-free system may contain enzymes related to DNA replication, repair, recombination, transcription, or for translation. Exemplary hosts include bacterial, yeast, plant and animal cells and cell lines, and include *E. coli, Pseudomonas fluorescens, Pichia pastoris* and *Aspergillus niger*. For example, XL1-Blue or Stb12 strains of *E. coli* can be used as hosts.

The method of the invention may be used with the same or different primers under different reaction conditions to promote products having different combinations or numbers of mutations.

By performing the exemplary method described above, this protocol also provides one or more polynucleotides produced by this TMCA evolution method, which then can be screened or selected for a desired property. One or more of the progeny polynucleotides can be expressed as polypeptides, and optionally screened or selected for a desired property. Thus, this embodiment of the TMCA evolution protocol provides polynucleotides and the encoded polypeptides, as well as libraries of such polynucleotides encoding such polypeptides. This embodiment of the TMCA evolution protocol further provides for screening the libraries by screening or selecting the library to obtain one or more polynucleotides encoding one or more polypeptides having the desired activity.

Another embodiment of the TMCA evolution protocol described in PCT/US08/071,771 comprises a method of producing a plurality of modified polynucleotides. Such methods generally include (a) adding at least three primers to a double stranded template polynucleotide in a single reaction mixture, wherein the at least three primers are not overlapping, and wherein each of the at least three primers comprise at least one mutation different from the other primers, wherein at least one primer is a forward primer that can anneal to a minus strand of the template and at least one primer is a reverse primer that can anneal to a plus strand of the template, and (b) subjecting the reaction mixture to a polymerase extension reaction to yield a plurality of extended modified polynucleotides from the at least three primers.

Another embodiment of the TMCA evolution protocol described in PCT/US08/071,771 comprises a method wherein a cell is transformed with the plurality of extended products that have not been treated with a ligase. In another embodiment of the invention, the plurality of extended modified polynucleotides is recovered from the cell. In another embodiment, the recovered plurality of extended modified polynucleotides is analyzed, for example, by expressing at least one of the plurality of extended modified polynucleotides and analyzing the polypeptide expressed therefrom. In another embodiment, the plurality of extended modified polynucleotides comprising the mutations of interest is selected.

In another embodiment of the TMCA evolution protocol, sequence information regarding the template polynucleotide is obtained, and three or more mutations of interest along the template polynucleotide can be identified. In another embodiment, products obtained by the polymerase extension can be analyzed before transforming the plurality of extended modified products into a cell.

In one embodiment of the TMCA evolution protocol, products obtained by the polymerase extension are treated with an enzyme, e.g., a restriction enzyme, such as a Dpn1 restriction enzyme, thereby destroying the template polynucleotide sequence. The treated products can be transformed into a cell, e.g., an *E. coli* cell.

In one embodiment of the TMCA evolution protocol, at least two, or at least three, or at least four, or at least five, or at least six, or at least seven, or at least eight, or at least nine, or at least ten, or at least eleven, or at least twelve, or more primers can be used. In one embodiment, each primer comprises a single point mutation. In another embodiment, two forward or two reverse primers comprise a different change in the same position on the template polynucleotide. In another embodiment, at least one primer comprises at least two changes in different positions on the template polynucleotide. In yet another embodiment, at least one primer comprises at least two changes in different positions and at least two forward or two reverse primers comprise a different change in the same position on the template polynucleotide.

In one embodiment of the TMCA evolution protocol, the forward primers are grouped into a forward group and the reverse primers are grouped into a reverse group, and the primers in the forward group and the primers in the reverse group, independent of one another, are normalized to be equal concentration in the corresponding group regardless of positions on the template polynucleotide, and wherein after the normalization an equal amount of the forward and reverse primers is added to the reaction. In this normalization method, a combination of some positions may be biased. The bias can be due to, for example, a relatively low primer concentration at one position containing a single primer compared to a position containing multiple primers. "Positional bias" refers to resulting polynucleotides which show a strong preference for the incorporation of primers at a single position relative to the other positions within its forward or reverse primer group. This results in a combination of modified polynucleotides which may have a high percentage of mutations within a single primer position but a low percentage of mutations at another position within its forward or reverse primer group. This bias is unfavorable when the goal of the TMCA is to generate progeny polynucleotides comprising all possible combinations of changes to the template. The bias can be corrected, for example, by normalizing the primers as a pool at each position to be equal.

In one embodiment of the TMCA evolution protocol, the primer normalization is performed by organizing the primers into multiple groups depending on their location on the template polynucleotide, wherein the primers covering the same selected region on the template are in one group; normalizing the grouped primers within each group to be equal concentration; pooling the forward primers within one group into a forward group and normalizing concentration between each group of the forward primers to be equal; pooling the reverse primers within one group into a reverse group and normalizing concentration between each group of the reverse primers to be equal; and adding an equal amount of the pooled forward and reversed primers into the reaction. No bias has been observed for position combinations.

In one embodiment of the TMCA evolution protocol, a set of degenerate primers each comprising a degenerate position is provided, wherein the mutation of interest is a range of different nucleotides at the degenerate position. In another embodiment, a set of degenerate primers is provided comprising at least one degenerate codon corresponding to at least one codon of the template polynucleotide and at least one adjacent sequence that is homologous to a sequence adjacent to the codon of the template polynucleotide sequence. In another embodiment, the degenerated codon is N,N,N and encodes any of 20 naturally occurring amino acids. In another embodiment, the degenerated codon encodes less than 20 naturally occurring amino acids.

Another embodiment of the TMCA evolution protocol described in PCT/US08/071,771 comprises a method of producing a plurality of modified polynucleotides comprising the mutations of interest. Such methods generally include (a) adding at least two primers to a double stranded template polynucleotide in a single reaction mixture, wherein the at least two primers are not overlapping, and wherein each of the at least two primers comprise at least one mutation different from the other primer(s), wherein at least one primer is a forward primer that can anneal to a minus strand of the template and at least one primer is a reverse primer that can anneal to a plus strand of the template, (b) subjecting the reaction mixture to a polymerase extension reaction to yield a plurality of extended modified polynucleotides from the at least two primers, (c) treating the plurality of extended modified polynucleotides with an enzyme, thereby destroying the template polynucleotide, (d) transforming the treated extended modified polynucleotides that have not been treated with a ligase into a cell, (e) recovering the plurality of extended modified polynucleotides from the cell, and (f) selecting the plurality of extended modified polynucleotides comprising the mutations of interest.

TABLE 50

List of Sites for TMCA evolution

| Mutation | New Codon |
| --- | --- |
| P20S | AGT |
| K73L | TTG |
| T74V | GTG |
| V93G | GGT |
| N110A | GCT |
| P117W | TGG |
| N118G | GGG |
| N118A | GCG |
| V236T | ACT |
| T241R | CGG |
| L270W | TGG |

TMCA mutants were grown, arrayed, assayed and sequenced using the same method as described for the GSSM evolution in Example 25. Sample performance was compared to the performance of the top candidate from GSSM evolution—Mutant 135—using the same scoring system as described in Example 25. Table 52 lists the TMCA secondary screen hits with unique DNA sequences (TMCA mutants are designated with alphabetic characters to distinguish them from GSSM mutants, which are designated numerically).

TABLE 52

TMCA Mutants Identified as Secondary Screen Hits

| Mutant name | Mutation |
| --- | --- |
| A | P20S-N118G |
| B | T74V-V93G-L270W |
| C | P20S-T74V-L270W |
| D | T74V-L270W |
| E | P20S-K73L-T241R-L270W |
| F | K73L-V93G-V236T-T241R |
| G | P20S-T74V-V236T |
| H | P20S-K73L-V93G |
| I | K73L-V236T |
| J | P20S-L270W |
| K | 2N-P20S-K73L-V93G-N118G |
| L | P20S-T74V-N118A |
| M | P20S-V236T |
| N | P20S-T241R-L270W |

TABLE 52-continued

TMCA Mutants Identified as Secondary Screen Hits

| Mutant name | Mutation |
|---|---|
| O | P20S-T241R |
| P | T74V-V93G-V236T-T241R |
| Q | P20S-K73L-T74V-L270W |
| R | P20S-V93G-V236T |
| S | P20S-K73L-T74V-T241R-L270W |
| T | P20S-K73L-L270W |
| U | T74V-V93G-N118G-V236T-T241R |
| V | P20S-K73L-210A (SILENT-GCC → GCT)-V236T |
| W | N118A-L270W |
| X | P20S-58K (SILENT AAG → AAA)-L270W |
| Y | P20S-V93G-N118G |
| Z | P20S-V236T-T241R |
| AA | P20S-P117W-N118A-V236T-L270W |
| BB | V93G-V236T |
| CC | V236T-L270W |
| DD | P20S-N118G-L270W |
| EE | P20S-N110A-N118G |
| FF | N110A-N118G-T241R-L270W |
| GG | P20S-T74V-V93G-N110A-N118G-V236T-L270W |
| HH | V93G-N110A-N118G-V236T |
| II | P20S-T74V-N110A-N118G |
| JJ | N110A-N118G |
| KK | P20S-V93G-N110A-N118G-T241R |
| LL | N110A-N118A-L270W |
| MM | P20S-N110A-N118G-L270W |
| NN | N110A-N118A-V236T-T241R |
| OO | N110A-N118G-L270W |
| PP | V93G-N110A-N118G-T241R |
| QQ | P20S-V93G-N110A-N118G |
| RR | V93G-N110A |
| SS | P20S-N110A-N118G-V236T |
| TT | T74V-N110A-N118A-V236T |
| UU | P20S-K73L-T74V-N110A-N118G-V236T-T241R |
| VV | 86E (SILENT GAG → GAA)-N110A-N118A-V236T |
| WW | T74V-N118G |
| XX | P20S-T241R-L270W-277T (SILENT ACA → ACG) |
| YY | T74V-N118A-L270W |
| ZZ | P20S-K73L-N118A-L270W |
| AAA | P20S-V93G-T241R |
| BBB | T74V-V93G-N110A-T241R |
| CCC | V93G-N110A-N118A |
| DDD | P20S-T74V-V93G-N110A-N118G-T241R |
| EEE | T74V-N110A-N118G-L270W |
| FFF | P20S-231A (SILENT GCG → GCA)-V236T |
| GGG | V93G-V236T-T241R |

The samples identified in Table 52 were grown, normalized and assayed in the tertiary screen using the same method as described for the GSSM evolution in Example 26. Monatin and alanine values were determined by LC/MS/MS and compared to a standard curve. Sample performance was compared to the activity of Mutant 135 (the top performer from GSSM evolution). TMCA upmutants identified in the tertiary screen are listed in Table 53.

Example 31

Activity of TMCA Hits

This example describes data demonstrating the enzymatic activity of exemplary polypeptides. Table 53 below shows the activity of the upmutants relative to Mutant 135 at the minute time point in reactions using 1 mM and 15 mM R,R-monatin substrate. Relative activity is the amount of alanine produced by the sample divided by the amount of alanine produced by Mutant 135.

TABLE 53

Activity of TMCA Upmutants in Tertiary Screen

| | | Activity relative to GSSM Mutant 135 | |
|---|---|---|---|
| Mutant | Mutation | Reactions with 1 mM monatin substrate | Reactions with 15 mM monatin substrate |
| C | P20S-T74V-L270W | 1.02 | 0.93 |
| E | P20S-K73L-T241R-L270W | 1.32 | 1.31 |
| F | K73L-V93G-V236T-T241R | 1.29 | 0.64 |
| G | P20S-T74V-V236T | 1.28 | 1.30 |
| I | K73L-V236T | 1.24 | 1.29 |
| J | P20S-L270W | 0.79 | 1.01 |

TABLE 53-continued

Activity of TMCA Upmutants in Tertiary Screen

| Mutant | Mutation | Activity relative to GSSM Mutant 135 | |
|---|---|---|---|
| | | Reactions with 1 mM monatin substrate | Reactions with 15 mM monatin substrate |
| L | P20S-T74V-N118A | 1.62 | 0.83 |
| M | P20S-V236T | 1.27 | 1.46 |
| O | P20S-T241R | 1.33 | 1.71 |
| R | P20S-V93G-V236T | 1.22 | 1.02 |
| S | P20S-K73L-T74V-T241R-L270W | 1.16 | 1.18 |
| V | P20S-K73L-210A (SILENT-GCC → GCT)-V236T | 1.03 | 1.00 |
| Z | P20S-V236T-T241R | 1.02 | 0.89 |
| BB | V93G-V236T | 1.55 | 1.98 |
| CC | V236T-L270W | 1.24 | 1.40 |
| DD | P20S-N118G-L270W | 1.54 | 1.78 |
| PP | V93G-N110A-N118G-T241R | 1.40 | 1.53 |
| TT | T74V-N110A-N118A-V236T | 1.10 | 0.42 |
| VV | 86E (SILENT GAG → GAA)-N110A-N118A-V236T | 1.31 | 0.52 |
| WW | T74V-N118G | 1.23 | 1.49 |
| YY | T74V-N118A-L270W | 1.97 | 1.30 |
| ZZ | P20S-K73L-N118A-L270W | 1.01 | 0.44 |
| AAA | P20S-V93G-T241R | 1.86 | 3.49 |
| CCC | V93G-N110A-N118A | 1.26 | 0.56 |

Several samples were identified that outperformed Mutant 135 under the conditions tested. Potential $K_m$ and $V_{max}$ upmutants were identified. The results of the GSSM and TMCA evolutions indicate that wild type SEQ ID NO:220 is further evolvable for increased specific activity on monatin.

Example 32

Evaluation of TMCA Mutant DATs in pMET1a

This example describes data demonstrating the enzymatic activity of exemplary polypeptides disclosed herein. Mutant E, Mutant G, Mutant I, Mutant M, Mutant O, Mutant P, Mutant BB, Mutant PP, Mutant WW, and Mutant AAA (DATs created using TMCA technology, see Examples 29 and 30) were recreated by site-directed mutagenesis using QuikChange Multi Site-Directed Mutagenesis Kit (Stratagene, La Jolla, Calif.) according to the manufacturer's instructions. To generate the mutants, pMET1a tagged constructs described in Example 16 and Example 28 were used as templates. The mutagenic primers used are listed below in Table 54. The PCR fragments were digested with Dpn1 (Invitrogen, Carlsbad, Calif.) for 1 hour and transformed into *E. coli* XL10-Gold cells (Stratagene, La Jolla, Calif.). The resultant purified plasmid preparations were sequenced (Agencourt, Beverly, Mass.) to verify that the correct mutations were incorporated. The plasmids were then transformed into *E. coli* B834(DE3) expression host (Novagen, San Diego, Calif.).

TABLE 54

Primers for Mutants in pMET1a Vector

| TMCA mutant polypeptide produced | PCR primers | Template |
|---|---|---|
| Mutant E | 5'-CTG GAC GAG ATG ACT GTG AGT ATG AAC GAC AGG GGC TGC TAC-3' (SEQ ID NO: 1104)<br>5'-TGC TTG TGT CCA GCA GCG GCC GGC TCG GCC TTA GCG CCG-3' (SEQ ID NO: 1105)<br>5'CTA AAA AAA ATC CAG GAT GAA GTG TGG AGG GAA TTT ATC GAA GCG ACA GG3' (SEQ ID NO: 1106) | Mutant 110 |
| Mutant G | 5'-CAA AAG AGG AAT TGA AAA AGT GTT AAA ATG AAA TGT ACT CC-3' (SEQ ID NO: 1107)<br>5'-GGA GTA CAT TTC ATT TAA CAC TTT TTT CAA TTC CTC TTT TG-3' (SEQ ID NO: 1108) | Mutant M |

TABLE 54-continued

Primers for Mutants in pMET1a Vector

| TMCA mutant polypeptide produced | PCR primers | Template |
|---|---|---|
| Mutant I | 5'-CTT AAC AAA AGA GGA ATT GAA ACT GAC TTT AAA TGA AAT GTA CTC C-3' (SEQ ID NO: 1109)<br>5'-GGA GTA CAT TTC ATT TAA AGT CAG TTT CAA TTC CTC TTT TGT TAA G-3' (SEQ ID NO: 1110) | Mutant 135 |
| Mutant M | 5'-CTG GAC GAG ATG ACT GTG AGT ATG AAC GAC AGG GGC TGC TAC-3' (SEQ ID NO: 1111)<br>5'-GTA GCA GCC CCT GTC GTT CAT ACT CAC AGT CAT CTC GTC CAG-3' (SEQ ID NO: 1112) | Mutant 135 |
| Mutant O | 5'-CTG GAC GAG ATG ACT GTG AGT ATG AAC GAC AGG GGC TGC TAC-3' (SEQ ID NO: 1113)<br>5'-GTA GCA GCC CCT GTC GTT CAT ACT CAC AGT CAT CTC GTC CAG-3' (SEQ ID NO: 1114) | Mutant 136 |
| Mutant P | 5'-CAA AAG AGG AAT TGA AAA AGT GTT AAA ATG AAA TGT ACT CC-3' (SEQ ID NO: 1115)<br>5'-TTC GAC GCG GAC GAG GTG CTT ACT TCC AGC AGC GGC ACA CTC G-3' (SEQ ID NO: 1116)<br>5'-TGC TTG TGT CCA GCA GCG GCC GGC TCG GCC TTA GCG CCG-3' (SEQ ID NO: 1117) | Mutant 27 |
| Mutant BB | 5'-TAC CTG GTT TAT TGG CAG GGT ACT CGC GGA ACA GGC CGG-3' (SEQ ID NO: 1118)<br>5'-CCG GCC TGT TCC GCG AGT ACC CTG CCA ATA AAC CAG GTA-3' (SEQ ID NO: 1119) | Mutant 135 |
| Mutant PP | 5'-TAC CTG GTT TAT TGG CAG GGT ACT CGC GGA ACA GGC CGG-3' (SEQ ID NO: 1120)<br>5'-TGC TTG TGT CCA GCA GCG GCC GGC TCG GCC TTA GCG CCG-3' (SEQ ID NO: 1121) | Mutant 45 |
| Mutant WW | 5'-CAA AAG AGG AAT TGA AAA AGT GTT AAA ATG AAA TGT ACT CC-3' (SEQ ID NO: 1122)<br>5'-GGA GTA CAT TTC ATT TAA CAC TTT TTT CAA TTC CTC TTT TG-3' (SEQ ID NO: 1123) | Mutant M |
| Mutant AAA | 5'-CTG GAC GAG ATG ACT GTG AGT ATG AAC GAC AGG GGC TGC TAC-3' (SEQ ID NO: 1124)<br>5'-TGC TTG TGT CCA GCA GCG GCC GGC TCG GCC TTA GCG CCG-3' (SEQ ID NO: 1125) | Mutant 27 |

*E. coli* B834(DE3) (Novagen, San Diego, Calif.) cultures expressing carboxy-terminal His-tagged Mutant 110, Mutant 135, Mutant 136, Mutant E, Mutant G, Mutant I, Mutant M, Mutant O, Mutant P, Mutant BB, Mutant PP, Mutant WW, Mutant AAA and wild type (SEQ ID NO:220) proteins were grown in 200 mL of Overnight Express II medium (Solution 1-6, Novagen) in a 500 mL baffled flask overnight at 30° C. to an $OD_{600}$ of 10. Samples for total protein were taken immediately prior to harvesting. Cells were harvested by centrifugation and immediately frozen at −80° C. until cell extracts were prepared as described in Example 4.

Cell extracts were created by the addition of 50 mL of Bug Buster Primary Amine Free (Novagen, San Diego, Calif.) with 50 µl of Benzonase Nuclease (Novagen, San Diego, Calif.), 0.75 µl of rLysozyme (Novagen, San Diego, Calif.), and 250 µl of Protease Inhibitor Cocktail II (Calbiochem, San Diego, Calif.). The cells were incubated for 15 minutes at room temperature with gentle rocking. The extracts were centrifuged at 45,000×g for 10 minutes.

His-tagged proteins were purified as described in Example 4 using GE Healthcare (Piscataway, N.J.) Chelating Sepharose™ Fast Flow resin. The exception was Mutant 182, which was analyzed as CFE as described in Example 4. Purified protein was desalted using a PD10 column into 100 mM potassium phosphate, pH 7.8 with 0.050 mM PLP. Total protein and DAT concentrations were determined as described in Example 4.

A 3-step monatin formation assay was done as described in Example 5 with a DAT concentration of approximately 0.2 mg/mL and the aldolase at a concentration of 0.1 mg/mL. As a control, 0.2 mg/mL concentration of purified wild type DAT (SEQ ID NO:220) was evaluated. After 0.5, 1, 2, 4 and 24 hours, an aliquot was taken, formic acid was added to a final concentration of 2% and the samples were spun and filtered. Samples were analyzed for monatin using LC/MS/MS methodology and for tryptophan and alanine using the LC/OPA post-column fluorescence methodology described in Example 36. At the last time point, an additional aliquot was taken (without pH adjustment) to determine % R,R monatin by the FDAA-derivatization method described in Example 36. The amount of monatin (mM) produced at various time points can be found in Table 55. Stereopurity was also determined and the percent of the R,R stereoisomer can be found in the far right hand column. The stereoisomer R,S made up the majority of the balance.

TABLE 55

Activity of Select DAT Mutants

| DAT polypeptide | Monatin (mM) 0.25 hr | Monatin (mM) 0.5 hr | Monatin (mM) 1 hr | Monatin (mM) 4 hr | % RR |
|---|---|---|---|---|---|
| Wild type control (SEQ ID NO: 220) | 1.60 (±0.42) | 2.95 (±0.64) | 5.00 (±0.85) | 11.40 (±0.42) | 99.50 (±0.08) |
| Mutant 110 | 1.70 (±0.00) | 3.20 (±0.85) | 5.75 (±0.21) | 12.60 (±0.14) | 99.48 (±0.32) |
| Mutant 135 | 3.65 (±0.35) | 6.17 (±0.65) | 10.33 (±0.32) | 13.20 (±0.56) | 99.42 (±0.11) |
| Mutant 136 | 2.60 | 5.00 | 8.10 | 12.90 | 98.98 |
| Mutant 182 | — | 3.20 | 6.80 | 14.30 | 99.50 |
| Mutant E | 1.80 | 3.80 | 8.60 | 18.60 | 99.45 |
| Mutant G | 3.10 | 6.50 | 9.90 | 12.90 | 99.05 |
| Mutant I | 2.90 | 5.30 | 8.50 | 12.90 | 99.46 |
| Mutant M | 4.20 | 8.10 | 11.20 | 13.80 | 98.96 |
| Mutant O | 2.60 | 5.70 | 9.50 | 14.00 | 98.59 |
| Mutant BB | 4.20 | 8.20 | 11.40 | 13.70 | 98.97 |
| Mutant PP | 2.40 | 3.20 | 6.20 | 17.40 | 97.25 |
| Mutant AAA | 2.80 | 6.80 | 11.80 | 14.80 | 97.98 |

—= not determined under conditions tested

The relative rates of monatin production under the conditions tested indicate the greatest improvement in initial activity from Mutant 135, Mutant 136, Mutant E, Mutant G, Mutant M, Mutant O, Mutant BB, and Mutant AAA as determined by comparing the rate of monatin formation with purified protein over the first hour between the mutants and the wild type control (SEQ ID NO:220) DAT. DATs Mutant E and Mutant AAA had high activity but were not well expressed (less than 5% of the total protein) nor very soluble under the conditions tested.

The assay samples were also analyzed for intermediates such as monatin precursor, I3P, and byproduct 4-hydroxy-4-methyl glutmatic acid (HMG) as described in Example 36. The analysis of the amount of HMG formed was determined for the mutants Mutant E, Mutant G, Mutant 1, Mutant M, Mutant O, Mutant BB, Mutant PP, Mutant AAA and Mutant 110, Mutant 135, and Mutant 136. It appears that at the 4 hour time point, more HMG were formed by the mutants Mutant 135, Mutant G, Mutant 1, Mutant M and Mutant BB. These mutants all contained the change V236T. HMG was also present above the levels of the wild type control (SEQ ID NO:220) with mutants Mutant E, Mutant G, Mutant M and Mutant AAA likely due to the change in residue P20S.

TABLE 56

HMG Formation by DAT Mutants after 4 hours

| DAT polypeptide | HMG (mM) 4 hr |
|---|---|
| Wild type control (SEQ ID NO: 220) | nd |
| Mutant 110 | nd |
| Mutant 135 | 1.0 |
| Mutant 136 | nd |
| Mutant E | 0.2 |
| Mutant G | 1.6 |
| Mutant I | 0.8 |
| Mutant M | 1.6 |
| Mutant O | nd |
| Mutant BB | 1.5 |
| Mutant AAA | 0.6 | nd = not detected

DAT Assay Monitoring I3P Formation

The formation of I3P from tryptophan was detected and monitored at a wavelength of 340 nm. Reactions were carried out in 1 mL reaction volume containing 900 µL, of a 25 mM D-tryptophan, 25 mM pyruvic acid sodium salt, 0.05 mM PLP, 100 mM potassium phosphate (pH 7.8) solution combined with 100 µL dilutions of DAT (total protein) prepared as described above. Enzymes were diluted 1:100 and 1:200 with cold 50 mM potassium phosphate (pH 7.8) and 50 µM PLP prior to addition to the assay. Enzyme was added to the reaction mixture 1:100 and monitored in increments of 15 seconds for 3 minutes. The formation of indole-3-pyruvate (I3P) was monitored at a wavelength of 340 nm for 3 minutes on a BioRad Spectrophotometer (GE Healthscience, Piscataway, N.J.) and rates were measured within the dynamic range of a standard curve. The standard curve was generated with purified wild type (SEQ ID NO:220) DAT protein and the concentration of DAT in cell extract was determined based on the equation of the line for the standard curve. The effective concentration of DAT with respect to the wild type DAT for the first reaction is reported in Table 57.

TABLE 57

Activity of DAT (Conversion of Tryptophan to I3P)

| DAT Polypeptide | Rate of I3P formation (Δ Abs340 nm/minute) | Concentration of DAT (determined by activity) mg/mL | Activity relative to Wild type of first reaction |
|---|---|---|---|
| Wild type control (SEQ ID NO: 220) | 0.058 | 0.065 | 1.0 |
| Mutant 135 | 0.067 | 0.075 | 1.2 |
| Mutant 136 | 0.017 | 0.019 | 0.3 |
| Mutant E | 0.000 | 0.002 | 0.1 |
| Mutant G | 0.027 | 0.030 | 0.5 |
| Mutant M | 0.050 | 0.055 | 0.9 |
| Mutant O | 0.031 | 0.033 | 0.8 |
| Mutant BB | 0.045 | 0.050 | 0.8 |
| Mutant AAA | 0.002 | 0.004 | 0.2 |

The wild type DAT (SEQ ID NO:220) and mutants 136, E, G, M, O, BB and AAA can facilitate the conversion of both tryptophan to I3P and of monatin precursor to monatin. Table 57 shows that these mutants had lower activity for the conversion of tryptophan to I3P relative to the wild type DAT (SEQ ID NO:220). Yet, according to Table 55, the same mutants produced more total monatin from tryptophan than did the wild type DAT (SEQ ID NO:220). Thus, under the conditions of the assay described herein, there appears to be a beneficial effect on monatin production through controlling the conversion of tryptophan to I3P in the monatin biosynthetic pathway. For example, although Mutant E showed the lowest relative activity for conversion of tryptophan to I3P (see Table 57), it also produced the highest amount of monatin at 4 hours (see Table 55). Without being bound by theory, the beneficial effects of controlling the first step in the reaction could be attributed to a reduction of I3P buildup and subsequent potential I3P degradation to products other than monatin. Generally, it also appears that controlling the rate of one or more of the reactions involved in the production of monatin from tryptophan, using, for example, one or more mutant DATs, can have a beneficial effect on the total amount of monatin produced.

Example 33

Evaluation of Mutant DATs at 35° C.

This example describes data demonstrating the enzymatic activity of exemplary polypeptides disclosed herein. Starter cultures were grown overnight at 37° C. with shaking at 250 rpm until the $OD_{600nm}$ reached 0.05. 200 mL of Overnight Express II medium (Novagen, San Diego, Calif.) was inoculated and grown as described in Example 3. Cultures were grown in duplicate and the cell pellets were combined. The pellets were resuspended in 40 mL of 50 mM sodium phosphate buffer (pH 7.8) with 0.05 mM PLP and lysed using a French Press (Sim Aminco, Rochester, N.Y.) per the manufacturer's instructions. The supernatant was collected in a clean tube and stored at −80° C. until used.

A 3-step monatin formation assay was performed as described in the methods with a DAT concentration of approximately 0.2 mg/mL and the aldolase at a concentration of 0.1 mg/mL in glass vials. Duplicate samples were incubated at either 25° C. or 35° C. and after 1, 3, and 4 hours, an aliquot was taken and formic acid was added to a final concentration of 2%, and the samples were spun and filtered. Samples were analyzed for monatin using LC/MS/MS methodology and for tryptophan and alanine using the LC/OPA post-column fluorescence methodology described in Example 36. Samples were also analyzed for intermediates such as monatin precursor, I3P, and 4-hydroxy-4-methyl glutmatic acid (HMG) as described in Example 36. The amount of monatin (mM) produced at various time points is shown in Table 58.

The monatin formation assay was repeated for the wild type control (SEQ ID NO:220), Mutant 135 and Mutant M under similar conditions except the reactions were carried out in plastic vials. Monatin production at various time points can be found in Table 58.

TABLE 58

Monatin Formation at 25° C. and 35° C.

| DAT polypeptide | Monatin (mM) 1 hr | Monatin (mM) 3 hr | Monatin (mM) 4 hr |
|---|---|---|---|
| 25° C. | | | |
| wild type control (pMet1a) | 2.0 | 6.8 | 8.4 |
| Mutant 135 (V236T) | 10.0 | 14.4 | 14.2 |
| Mutant 136 (241R) | 4.0 | 10.8 | 12.4 |
| Mutant E (20S, 73L, 241R, 270W) | 0.8 | 4.2 | 5.6 |

TABLE 58-continued

Monatin Formation at 25° C. and 35° C.

| DAT polypeptide | Monatin (mM) 1 hr | Monatin (mM) 3 hr | Monatin (mM) 4 hr |
|---|---|---|---|
| Mutant M (20S, 236T) | 10.0 | 13.4 | 14.2 |
| Mutant O (20S, 241R) | 8.0 | 13.8 | 13.6 |
| Mutant BB (93G, 236T) | 4.0 | 11.4 | 12.4 |
| Mutant AAA (20S, 93G, 241R) | 0.2 | 1.0 | 1.6 |
| 35° C. | | | |
| wild type control (pMet1a) | 2.2 | 5.4 | 6.2 |
| Mutant 135 (V236T) | 9.4 | 9.2 | 9.8 |
| Mutant 136 (241R) | 4.8 | 9.4 | 10.4 |
| Mutant E (20S, 73L, 241R, 270W) | 0.6 | 3.4 | 4.2 |
| Mutant M (20S, 236T) | 9.2 | 13.6 | 14.6 |
| Mutant O (20S, 241R) | 9.6 | 10.6 | 10.8 |
| Mutant BB (93G, 236T) | 4.6 | 9.0 | 9.2 |
| Mutant AAA (20S, 93G, 241R) | 0.2 | 1.6 | 2.2 |

Lower monatin titers were observed using the DAT enzymes described here at 35° C. under the conditions of the assay. However, select mutants Mutant 135, Mutant 136, Mutant M, Mutant O and Mutant BB showed increased initial monatin production rates and greater 4 hour monatin titers than the wild type control (SEQ ID NO:220) at 35° C. under the assay conditions.

Example 34

Evaluation of Mutant DATs in BioReactors

This example describes data demonstrating the enzymatic activity of exemplary polypeptides disclosed herein in bioreactors. Glycerol stocks of the wild type control (SEQ ID NO:220), Mutant 135, Mutant 136, Mutant M, Mutant O, and Mutant BB were used to streak plates for single colonies. Single colonies were used to inoculate flasks containing 5 mL of LB medium with the appropriate antibiotic. The starter cultures were grown overnight at 37° C. with shaking at 250 rpm and the $OD_{600nm}$ was checked. When the $OD_{600nm}$ reached 0.05, the 5 mL culture was inoculated into a 200 mL of Overnight Express II medium (Novagen, San Diego, Calif.) and then incubated at 30° C. with shaking at 250 rpm. Each culture was grown in duplicate and the cell pellets were combined. Cultures were harvested by pelleting cells by centrifugation at 4000 rpm for 15 minutes. The supernatant was poured off and the pellet was either frozen for later use or resuspended in 40 mL of 50 mM sodium phosphate buffer (pH 7.8) and lysed using a French Press (Sim Aminco, Rochester, N.Y.) or a microfluidizer (Microfluidics Corporation, Newton, Mass.) per the manufacturer's instructions. The supernatant was collected in a clean tube and stored at −80° C. until used. Approximately 1 mL of the clarified lysate was retained for protein quantitation using the BCA assay (Pierce, Rockford, Ill.) and SDS-PAGE analysis.

Bench scale reactions (250 mL) were carried out in 0.7 L Sixfors agitated fermentors (Infors AG, Bottmingen, Switzerland) under a nitrogen headspace as described in Example 15. The reaction mix contained 10 mM potassium phosphate, 1 mM $MgCl_2$, 0.05 mM PLP, 200 mM sodium pyruvate and 130 mM D-tryptophan. The reaction mix was adjusted to 25° C. and adjusted to pH 7.8 with potassium hydroxide. The aldolase described in Example 6 was added as a clarified cell extract at 0.02 mg/mL of target protein. Wild type control (SEQ ID NO:220), Mutant 135, Mutant 136, Mutant M, Mutant O, and Mutant BB DATs have soluble protein expressions ranging from 15-35% based on visual estimation. The clarified cell extracts were added at 0.20 mg/mL of target protein.

The progress of the reactions was followed by measuring monatin production at 1, 2, 4 and 24 hours using the LC/MS/MS methodology described in Example 36. The results are shown in Table 59.

TABLE 59

Monatin Production in Fermentors

| DAT polypeptide | Protein Expression | Monatin (mM) 1 hr | Monatin (mM) 2 hr | Monatin (mM) 4 hr | Monatin (mM) 24 hr |
|---|---|---|---|---|---|
| wild type control | 25% | 0.90 | 2.80 | 12.40 | 12.80 |
| Mutant 135 | 30% | 0.50 | 8.80 | 12.40 | 12.40 |
| Mutant 136 | 35% | 3.80 | 7.80 | 11.60 | 12.80 |
| Mutant M | 15% | 3.40 | 6.80 | 12.10 | 12.20 |
| Mutant O | 15% | 5.20 | 8.60 | 10.90 | 9.80 |
| Mutant BB | 15% | 3.40 | 6.20 | 10.50 | 12.60 |

The initial rate of monatin production observed with mutants Mutant 136, Mutant M, Mutant O, and Mutant BB was faster than the rate with the wild type control (SEQ ID NO:220). All the mutants showed improved monatin formation at 2 hours under the conditions tested. The lower than expected monatin titer at 1 hour for Mutant 135 was attributed to the inadvertent exposure to oxygen during the first hour. After 4 hours, the monatin titer was comparable between the mutants and the control under the conditions tested.

Example 35

Evaluation of the Impact of Temperature on Mutant DATs in BioReactors

This example describes data demonstrating the enzymatic activity of exemplary polypeptides disclosed herein under different temperature conditions. The wild type control (SEQ ID NO:220), Mutant 135 and Mutant M were produced in a fermentor at the 2.5 L scale as described in Example 15. At the end of fermentation, the cells were harvested by centrifugation at 5000-7000×g for 10 minutes and frozen as a wet cell paste at −80° C.

To prepare cell free extract containing the wild type control, Mutant 135 and Mutant M D-aminotransferases, 50 g of wet cell paste was suspended in 150 mL of 50 mM potassium phosphate buffer (pH 7.8) containing 0.05 mM pyridoxal phosphate (PLP) and then disrupted using a Microfluidics homogenizer (Microfluidics, Newton, Mass.) (3 passes at 18,000 psi), maintaining the temperature of the suspension at less than 15° C. Cellular debris was removed by centrifugation (20,000×g for 30 minutes).

The rate of formation of I3P from tryptophan was monitored at 340 nm for three minutes as described in Example 32. The concentration of the wild type control was determined to be 6.8 mg/mL, the concentration of Mutant 135 was determined to be 7.0 mg/mL and Mutant M was determined to be 5.6 mg/mL based on a standard curve generated with purified DAT wild type control. The DAT concentrations determined by I3P formation were used to dose the Infors to 0.2 mg/mL DAT. The aldolase was added as a cell free extract at 0.02 mg/mL aldolase. The reaction mix contained 10 mM potassium phosphate, 1 mM $MgCl_2$, 0.05 mM PLP, 200 mM sodium pyruvate and 130 mM D-tryptophan under a nitrogen headspace. Each of the DATs was evaluated for monatin production in a bioreactor at 35° C. and at 25° C.

Samples were taken at 0.5, 1, 3, 4 and 24 hours and analyzed using the LC/MS/MS methodology described in Example 36. The results are shown in Table 60.

TABLE 60

Fermenters at 25° and 35° C.

| DAT polypeptide | Monatin (mM) 0.5 hr | Monatin (mM) 1 hr | Monatin (mM) 3 hr | Monatin (mM) 4 hr | Monatin (mM) 24 hr |
|---|---|---|---|---|---|
| 25° C. | | | | | |
| Wild type control (SEQ ID NO: 220) | 0.9 | 2.4 | 5.6 | 7.9 | 19.1 |
| Mutant 135 | 1.6 | 4.4 | 10.9 | 12.1 | 18.6 |
| Mutant M | 2.1 | 4.5 | 9.4 | 12.4 | 17.4 |
| 35° C. | | | | | |
| Wild type control (SEQ ID NO: 220) | 2.3 | 3.9 | 6.5 | 7.9 | 10.7 |
| Mutant 135 | 4.1 | 6.1 | 9.8 | 11.5 | 14.9 |
| Mutant M | 4.1 | 6.3 | 9.9 | 11.3 | 14.9 |

As seen in Example 34, select mutant DATs yielded higher monatin titers at 35° C. compared to the wild type control DAT (SEQ ID NO:220). The wild type control DAT had a slower initial rate of monatin production but a higher final titer at 25° C. under the conditions tested. Both mutants Mutant 135 and Mutant M showed improved activity over the wild type control at 25° C. and 35° C. Mutants Mutant 135 and Mutant M had both a higher initial rate of monatin production and a higher final titer at 35° C. compared to the control under the conditions tested. The selected mutants were more stable than the wild type control at the higher temperatures. This indicates the advantages of GSSM and TMCA technologies in producing mutants with greater thermostability than the wild type control. One skilled in the arts could screen these GSSM or TMCA libraries for mutants with, for example, increased temperature tolerance.

Example 36

Detection of Monatin, MP, Tryptophan, Alanine, and HMG

This example describes the analytical methodology associated with the further characterization of exemplary D-aminotransferase (DAT) enzymes disclosed herein.

UPLC/UV Analysis of Monatin and Tryptophan

Analyses of mixtures for monatin and tryptophan derived from biochemical reactions were performed using a Waters Acquity UPLC instrument including a Waters Acquity Photo-Diode Array (PDA) absorbance monitor. UPLC separations were made using an Agilent XDB C8 1.8 μm 2.1×100 mm column (part #928700-906) (Milford, Mass.) at 23° C. The UPLC mobile phase consisted of A) water containing 0.1% formic acid B) acetonitrile containing 0.1% formic acid.

The gradient elution was linear from 5% B to 40% B, 0-4 minutes, linear from 40% B, to 90% B, 4-4.2 minutes, isocratic from 90% B to 90% B, 4.2-5.2 minutes, linear from 90% B to 5% B, 5.2-5.3 minutes, with a 1.2 minute re-equilibration period between runs. The flow rate was 0.5 mL/min, and PDA absorbance was monitored at 280 nm.

Sample concentrations are calculated from a linear least squares calibration of peak area at 280 nm to known concentration, with a minimum coefficient of determination of 99.9%.

Derivatization of Monatin Intermediates (Indole-3-Pyruvic Acid (I3P), Hydroxymethyloxyglutaric Acid, Monatin Precursor, and Pyruvate) with O-(4-Nitrobenzyl)hydroxylaminehydrochloride (NBHA)

In the process of monatin production, various intermediate compounds are formed and utilized. These compounds include: Indole-3-Pyruvic Acid (I3P), Hydroxymethyloxyglutaric Acid, Monatin Precursor, and Pyruvate. The ketone functional group on these compounds can be derivatized with O-(4-Nitrobenzyl)hydroxylamine hydrochloride (NBHA).

To 20 µL of sample or standard, 140 µL of NBHA (40 mg/mL in pyridine) was added in an amber vial. Samples were sonicated for 15 min in the presence of heat with occasional mixing. A 1:3 dilution in 35% Acetonitrile in water was performed.

UPLC/UV Analysis of Monatin Intermediates (Indole-3-Pyruvic Acid, Hydroxymethyloxyglutaric Acid, Monatin Precursor, and Pyruvate)

A Waters Acquity UPLC instrument including a Waters Acquity Photo-Diode Array (PDA) absorbance monitor (Waters, Milford, Mass.) was used for the analysis of the intermediate compounds. UPLC separations were made using a Waters Acquity HSS T3 1.8 mm×150 mm column (Waters, Milford, Mass.) at 50° C. The UPLC mobile phase consisted of A) water containing 0.3% formic acid and 10 mM ammonium formate and B) 50/50 acetonitrile/methanol containing 0.3% formic acid and 10 mM ammonium formate.

The gradient elution was linear from 5% B to 40% B, 0-1.5 minutes, linear from 40% B, to 50% B, 1.5-4.5 minutes, linear from 50% B to 90% B, 4.5-7.5 minutes, linear from 90% B to 95% B, 7.5-10.5 minutes, with a 3 minute re-equilibration period between runs. The flow rate was 0.15 mL/min from 0-7.5 minutes, 0.18 mL/min from 7.5-10.5 minutes, 0.19 mL/min from 10.5-11 minutes, and 0.15 mL/min from 11-13.5 minutes. PDA absorbance was monitored at 270 nm.

Sample concentrations were calculated from a linear least squares calibration of peak area at 270 nm to known concentration, with a minimum coefficient of determination of 99.9%.

Chiral LC/MS/MS (MRM) Measurement of Monatin

Determination of the stereoisomer distribution of monatin in biochemical reactions was accomplished by derivatization with 1-fluoro-2-4-dinitrophenyl-5-L-alanine amide (FDAA), followed by reversed-phase LC/MS/MS MRM measurement.

Derivatization of Monatin with FDAA

100 µL of a 1% solution of FDAA in acetone was added to 50 µL of sample or standard. Twenty µL of 1.0 M sodium bicarbonate was added, and the mixture was incubated for 1 hour at 40° C. with occasional mixing. The sample was removed and cooled, and neutralized with 20 µL of 2.0 M HCl (more HCl may be required to effect neutralization of a buffered biological mixture). Samples were analyzed by LC/MS/MS.

LC/MS/MS Multiple Reaction Monitoring for the Determination of the Stereoisomer Distribution of Monatin Analyses were performed using the Waters/Micromass® liquid chromatography-tandem mass spectrometry (LC/MS/MS) instrument including a Waters 2795 liquid chromatograph with a Waters 996 Photo-Diode Array (PDA) absorbance monitor (Waters, Milford, Mass.) placed in series between the chromatograph and a Micromass® Quattro Ultima® triple quadrupole mass spectrometer. The LC separations capable of separating all four stereoisomers of monatin (specifically FDAA-monatin) were performed on a Phenomenex Luna® 2.0×250 mm (3 µm) C18 reversed phase chromatography column at 40° C. The LC mobile phase consisted of A) water containing 0.05% (mass/volume) ammonium acetate and B) acetonitrile. The elution was isocratic at 13% B, 0-2 minutes, linear from 13% B to 30% B, 2-15 minutes, linear from 30% B to 80% B, 15-16 minutes, isocratic at 80% B 16-21 minutes, and linear from 80% B to 13% B, 21-22 minutes, with a 8 minute re-equilibration period between runs. The flow rate was 0.23 mL/min, and PDA absorbance was monitored from 200 nm to 400 nm. All parameters of the ESI-MS were optimized and selected based on generation of deprotonated 20 molecular ions ([M−H]−) of FDAA-monatin, and production of characteristic fragment ions. The following instrumental parameters were used for LC/MS analysis of monatin in the negative ion ESI/MS mode: Capillary: 3.0 kV; Cone: 40 V; Hex 1: 15 V; Aperture: 0.1 V; Hex 2: 0.1 V; Source temperature: 120° C.; Desolvation temperature: 350° C.; Desolvation gas: 662 L/h; Cone gas: 42 L/h; Low mass resolution (Q1): 14.0; High mass resolution (Q1): 15.0; Ion energy: 0.5; Entrance: 0 V; Collision Energy: 20; Exit: 0 V; Low mass resolution (Q2): 15; High mass resolution (Q2): 14; Ion energy (Q2): 2.0; Multiplier: 650. Three FDAA-monatin-specific parent-to-daughter transitions were used to specifically detect FDAA-monatin in in vitro and in vivo reactions. The transitions monitored for monatin were 542.97 to 267.94, 542.97 to 499.07, and 542.97 to 525.04. Identification of FDAA-monatin stereoisomers was based on chromatographic retention time as compared to purified monatin stereoisomers, and mass spectral data.

Liquid Chromatography-Post Column Derivatization with OPA, Fluorescence Detection of Amino Acids, Including: Hydroxymethyl Glutamate (HMG) and Alanine Analyses of mixtures for HMG and alanine derived from biochemical reactions were performed using a Waters Alliance 2695 and a Waters 600 configured instrument with a Waters 2487 Dual Wavelengths Absorbance Detector and Waters 2475 Fluorescence Detector as a detection system (Waters, Milford, Mass.). HPLC separations were made using two Phenomenex Aqua C18 125A, 150 mm×2.1 mm, 3µ, Cat #00F-4311B0 columns in series as the analytical columns, and a Phenomenex Aqua C18 125A, 30 mm×2.1 mm, 3µ, Cat #00A-4311B0 as an on-line solid phase extraction (SPE) column. Temperature for the two analytical columns was set at 55° C., and the on-line SPE column was at room temperature. The HPLC mobile phase consisted of A) 0.6% acetic acid with 1% methanol. The flow rate was (100% A) 0.2 mL/min from 0-3.5 minutes, 0.24 mL/min from 3.5-6.5 minutes, 0.26 mL/min from 6.5-10.4 minutes, and 0.2 mL/min from 10.4-11 minutes. UV-VIS absorbance detector was set to monitor at 336 nm wavelength. Fluorescence detector was set at 348 nm and 450 nm to monitor the excitation and emission wavelengths respectively.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

APPENDIX 1

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 1, 2 | conserved hypothetical protein [Aspergillus terreus NIH2624] | 115385557 | 1.00E-125 | Aspergillus terreus NIH2624 | Amino-transferase/mutase/deaminase enzyme #14. | ADS78245 | 1.00E-168 | Amino-transferase/mutase/deaminase enzyme #14. | ADS78244 | 0 | 2.6.1.42 | 879 | 292 | 954 | 317 | | |
| 3, 4 | amino-transferase; class IV [Silicibacter sp TM1040] | 99078146 | 1.00E-96 | Silicibacter sp. TM1040 | Bacterial polypeptide #19. | ADF03944 | 9.00E-69 | Plant cDNA #31 | ADJ41018 | 2.4 | 2.6.1.21 | 855 | 284 | 0 | 286 | 66 | |
| 5, 6 | D-amino acid amino-transferase [Rhodo-pseudomonas palustris CGA009] | 39935662 | 8.00E-77 | Rhodo-pseudomonas palustris CGA009 | Bacterial polypeptide #19. | ADF03944 | 1.00E-53 | S. hygroscopicus geldanamycin PKS AT1 mutant fragment, SEQ ID NO:83. | ADI39160 | 0.61 | 2.6.1.21 | 855 | 284 | 0 | 285 | 51 | |
| 7, 8 | D-alanine transaminase [Azoarcus sp. BH72] | 119896473 | 1.00E-92 | Azoarcus sp. BH72 | P. stutzeri 4 D-HPG AT outer forward N-term PCR primer 1. | AEM18040 | 7.00E-55 | Klebsiella multi-copper oxidase. | ABZ69309 | 0.16 | 2.6.1.21 | 870 | 289 | 0 | 285 | 58 | |
| 9, 10 | amino-transferase class IV [Nitrosomonas eutropha C91] | 114330773 | 2.00E-46 | Nitrosomonas eutropha C91 | Prokaryotic essential gene #34740. | ABU33175 | 2.00E-20 | Prokaryotic essential gene #34740. | ACA26397 | 0.28 | 2.6.1.21 | 435 | 144 | 0 | 286 | 60 | |
| 11, 12 | D-alanine aminotransferase [Xanthobacter autotrophicus Py2] gi|89350945|gb|E AS 16227.1| D-alanine aminotransferase [Xanthobacter autotrophicus Py2] | 89360213 | 5.00E-85 | Xanthobacter autotrophicus Py2 | Bacterial polypeptide #19. | ADF03944 | 7.00E-55 | Drosophila melanogaster Dolypeptide SEQ ID NO 24465 | ABL17260 | 2.5 | 2.6.1.21 | 879 | 292 | 0 | 285 | 56 | |
| 13, 14 | D-amino acid aminotransferase [Clostridium beijerincki | 82745661 | 2.00E-99 | Clostridium beijerincki NCIMB 8052 | P. stulzeri 4 D-HPG AT outer forward | AEM18031 | 2.00E-46 | Human gene 18-encoded secreted protein | AAH32576 | 0.039 | 2.6.1.21 | 855 | 284 | 0 | 282 | 63 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
|  | NCIMB 8052] gi 82726488 gb E AP61226.1 D-amino acid aminotransferase [Clostridium Beijerincki NCIMB 8052] |  |  |  | N-term PCR primer 1 |  |  | HCUGC55, SEQ ID NO: 185 |  |  |  |  |  |  |  |  |  |
| 15, 16 | d-alanine aminotransferase [Alcanivorax borkumensis SK2] | 110834821 | 4.00E-56 | Alcanivorax borkumensis SK2 | Bacillus D-amino acid amino-transferase. | AAY13560 | 2.00E-54 | Bacterial polypeptide #19. | ADE99771 | 0.038 | 2.6.1.21 | 837 | 278 | 0 | 294 | 45 |  |
| 17, 18 | PUTATIVE BRANCHED-CHAIN AMINO ACID AMINOTRANSFE RASE (TRANSAMINAS E B) (BCAT). | 3122274 | 6.00E-49 | Methano-thermobacter therm-autotrophicus | Prokaryotic essential gene #34740. | ABU21638 | 2.00E-45 |  |  | 0 | 2.6.1.42 | 918 | 305 | 0 | 306 | 34 |  |
| 19, 20 | D-amino acid aminotransferase [Clostridium beijerincki NCIMB 8052] gi 82726488 gb E AP61226.1 D-amino acid aminotransferase [Clostridium beijerincki NCIMB 8052] | 82745661 | 7.00E-97 | Clostridium beijerincki NCIMB 8052 | P. stutzeri 4 D-HPG AT outer forward N-term PCR primer 1. | AEM18031 | 1.00E-47 | Drosophila melanogaster polypeptide SEQ ID NO 24465. | ABL03988 | 2.4 | 2.6.1.21 | 861 | 286 | 0 | 282 | 61 |  |
| 21, 22 | D-amino acid aminotransferase [Clostridium beijerincki NCIMB 8052] gi 82726488 gb E AP61226.1 D-amino acid aminotransferase [Clostridium beijerincki NCIMB 8052] | 82745661 | 1.00E-100 | Clostridium beijerincki NCIMB 8052 | Mutant Bacillus sphaericus dat protein. | ABB08244 | 2.00E-47 | Photorhabdus luminescens protein sequence #59. | ACF71263 | 2.4 | 2.6.1.21 | 861 | 286 | 0 | 282 | 63 |  |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 23, 24 | D-amino acid aminotransferase [Clostridium beijerinckii NCIMB 8052] gi|82726488|gb|E AP61226.1|D-amino acid aminotransferase [Clostridium beijerinckii NCIMB 8052] | 82745661 | 6.00E-96 | Clostridium beijerinckii NCIMB 8052 | Mutant Bacillus sphaericus dat protein. | ABB08244 | 5.00E-46 | Mouse mCG15938 gene coding DNA (cDNA) sequence. | ADA66322 | 0.16 | 2.6.1.21 | 861 | 286 | 0 | 282 | 61 | |
| 25, 26 | D-amino acid aminotransferase putative [Methylococcus capsulatus str. Bath] | 53802655 | 3.00E-86 | Methylococcus capsulatus str. Bath | Staphylococcus aureus protein #10. | ABM71198 | 2.00E-53 | Human ORFX protein sequence SEQ ID NO: 19716. | ABN23130 | 0.6 | 2.6.1.21 | 840 | 279 | 0 | 283 | 55 | |
| 27, 28 | aminotransferase, class IV [Nocardioides sp. JS614] gi|119537255|gb| ABL81872.1| aminotransferase, class IV [Nocardioides sp. JS614] | 119716594 | 9.00E-33 | Nocardioides sp. JS614 | Escherichia coli aminotransferase ilvE SEQ ID NO 2. | AEK20408 | 3.00E-27 | Human Toll/interleukin receptor-like protein for cancer treatment. | ADL15020 | 0.57 | 2.6.1.42 | 801 | 266 | 0 | 274 | 37 | |
| 29, 30 | D-amino acid aminotransferase [Clostridium acetobutylicum] | 15894079 | 3.00E-81 | Clostridium acetobutylicum | Prokaryotic essential gene #34740. | ABU32980 | 1.00E-45 | Human immune/haematopoietic entigen genomic sequence SEQ ID NO: 41436. | AAK71577 | 0.6 | 2.6.1.21 | 849 | 282 | 843 | 280 | 51 | 51 |
| 31, 32 | histidinol-phosphate aminotransferase [Methanococcus maripaludis C7] gi|145278069|gb| EDK17867.1| histidinol-phosphate aminotransferase [Methanococcus maripaludis C7] | 145644535 | 1.00E-40 | Methanococcus maripaludis c7 | Bacterial polypeptide #10001. | ADS43070 | 2.00E-37 | Human nervous system related polynucleotide SEQ ID NO: 115893 | ABA15896 | 0.003 | 2.6.19 | 1062 | 353 | 0 | 371 | 32 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 33, 34 | D-ALANINE AMINOTRANSFERASE (D-ASPARTATE AMINOTRANSFERASE) (D-AMINO ACID AMINOTRANSFERASE) (D-AMINO ACID TRANSAMINASE) (DAAT), | 118222 | 1.00E-108 | Bacillus sp. YM-1 | P. stutzeri 4 D-HPGAT outer forward N-term PCR primer 1. | AEM18018 | 1.00E-108 | Listeria innocua DNA sequence #303. | ABQ69245 | 4.00E-08 | 2.6.1.21 | 852 | 283 | 0 | 283 | 66 | |
| 35, 36 | pyridoxal phosphate-dependent enzyme, putative [Caldivirga maquilingensis IC-167] gi\|126311802\|gb\|EAZ64256.1\| pyridoxal phosphate-dependent enzyme, putative [Caldivirga maquilingensis IC-167] | 126353148 | 2.00E-53 | Caldivirga maquilingensis IC-167 | Klebsiella pneumoniae polypeptide seq id 7178. | ABO62434 | 2.00E-31 | Pseudomonas aeruginosa polypeptide #3. | ABD13518 | 0.21 | 2.9.1.1 | 1143 | 380 | 0 | 388 | 35 | |
| 37, 38 | glutamate-1-semialdehyde 2,1-aminomutase; putative [Planctomyces maris DSM 8797] | 149173540 | 1.00E-104 | Planctomyces maris DSM 8797 | Bacterial polypeptide #10001. | ADN26446 | 2.00E-94 | Human ORFX protein sequence SEQ ID NO: 19716. | ABN18447 | 0.017 | 5.4.3.8 | 1389 | 462 | 0 | 455 | 43 | |
| 39, 40 | Serine-glyoxylate transaminase [Acidiphilium cryptum JF-5] | 148260372 | 1.00E-94 | Acidiphilium cryptum JF-5 | Prokaryotic essential gene #34740. | ABU21492 | 1.00E-68 | Plant full length insert polynucleotide seqid 4980. | ADO84697 | 0.05 | 2.6.1.45 | 1080 | 359 | 0 | 397 | 48 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 41, 42 | Chain A, Crystallographic Structure Of D-Amino Acid Aminotransferase Complexed With Pyridoxal-5 Phosphate. | 1127164 | 1.00E-126 | *Bacillus* sp. YM-1 | P. stutzeri 4 D-HPG AT outer forward N-term PCR primer 1. | AEM18037 | 1.00E-126 | D-amino acid transaminase. | AAN81507 | 1.00E-20 | 2.6.1.21 | 852 | 283 | 0 | 282 | 76 | |
| 43, 44 | glutamate-1-semialdehyde 2,1-aminomutase; putative [*Planctomyces maris* DSM 8797] | 149173540 | 1.00E-115 | *Planctomyces maris* DSM 8797 | Bacterial polypeptide #10001. | ADN26446 | 1.00E-95 | Drosophila melanogaster Polypeptide SEQ ID NO 24465. | ABL08182 | 0.99 | 5.4.3.8 | 1350 | 449 | 0 | 455 | 48 | |
| 45, 46 | Serine-glyoxylate transaminase [*Acidiphilium cryptum* JF-5] | 148260372 | 1.00E-111 | *Acidiphilium cryptum* JF-5 | Prokaryotic essential gene #34740. | ABU21492 | 1.00E-82 | Prokaryotic essential gene #34740. | ACA25362 | 6.00E-08 | 2.6.1.45 | 1170 | 389 | 0 | 397 | 51 | |
| 47, 48 | glutamate-1-semialdehyde 2,1-aminomutase; putative [*Planctomyces maris* DSM 8797] | 149173540 | 1.00E-103 | *Planctomyces maris* DSM 8797 | Bacterial polypeptide #10001. | ADN26446 | 1.00E-94 | Human metal ion transporter, 85080. | ACA62990 | 0.066 | 5.4.3.8 | 1401 | 466 | 0 | 455 | 42 | |
| 49, 50 | aminotransferase class-III [*Roseiflexus castenholzii* DSM 13941] gi|118014341|gb| EAV28318.1| aminotransferase class-III [*Roseiflexus castenholzii* DSM 13941] | 118061613 | 1.00E-108 | *Roseiflexus castenholzii* DSM 13941 | Bacterial Polypeptide #10001. | ADN26446 | 4.00E-93 | Bacterial Polypeptide #10001. | ADS63519 | 7.00E-08 | 5.4.3.8 | 1353 | 450 | 0 | 454 | 49 | |
| 51, 52 | aminotransferase class-III [*Roseiflexus castenholzii* DSM 13941] gi|118014341|gb| EAV28318.1| aminotransferase class-III [*Roseiflexus castenholzii* DSM 13941] | 118061613 | 1.00E-107 | *Roseiflexus castenholzii* DSM 13941 | Bacterial Polypeptide #10001. | ADN26446 | 8.00E-98 | Clone FS3-135 DNA sequence SEQ ID NO: 2. | ADH48029 | 1.00E-09 | 5.4.3.8 | 1344 | 447 | 0 | 454. | 47 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 53, 54 | D-alanine aminotransferase [Lactobacillus salivarius subsp. salivarius UCC118] | 90962639 | 3.00E-70 | Lactobacillus salivarius subsp. salivarius UCC118 | Staphylococcus aureus protein #10. | ABM71198 | 2.00E-36 | Prokaryotic essential gene #34740. | ACA53304 | 2.4 | 2.6.1.21 | 861 | 286 | 0 | 281 | 49 | |
| 55, 56 | aminotransferase; class I and II [Pseudomonas putida F1] | 148547264 | 2.00E-66 | Pseudomonas putida F1 | Pseudomonas aeruginosa polypeptide #3. | ABO84364 | 2.00E-55 | Pseudomonas aeruginosa polypeptide #3. | ABD17818 | 4.00E-34 | 2.6.1.1 | 399 | 132 | 0 | 396 | 94 | |
| 57, 58 | aminotransferase; class I and II [Pseudomonas putida F1] | 148547264 | 5.00E-66 | Pseudomonas putida F1 | Pseudomonas aeruginosa polypeptide #3. | ABO84364 | 6.00E-55 | Pseudomonas aeruginosa polypeptide #3. | ABD17818 | 6.00E-36 | 2.6.1.1 | 399 | 132 | 0 | 396 | 93 | |
| 59, 60 | aminotransferase; class I and II [Pseudomonas putida F1] | 148547264 | 1.00E-65 | Pseudomonas putida F1 | Pseudomonas aeruginosa polypeptide #3. | ABO84364 | 2.00E-54 | Pseudomonas aeruginosa polypeptide #3. | ABD17818 | 9.00E-29 | 2.6.1.1 | 399 | 132 | 0 | 396 | 93 | |
| 61, 62 | aminotransferase; class I and II [Pseudomonas putida F1] | 148547264 | 2.00E-66 | Pseudomonas putida F1 | Pseudomonas aeruginosa polypeptide #3. | ABO84364 | 2.00E-55 | Pseudomonas aeruginosa polypeptide #3. | ABD17818 | 1.00E-34 | 2.6.1.1 | 399 | 132 | 0 | 396 | 94 | |
| 63, 64 | aminotransferase; class I and II [Pseudomonas putida F1] | 148547264 | 1.00E-65 | Pseudomonas putida F1 | Pseudomonas aeruginosa polypeptide #3. | ABO84364 | 7.00E-56 | Pseudomonas aeruginosa polypeptide #3. | ABD17818 | 7.00E-48 | 2.6.1.1 | 399 | 132 | 0 | 396 | 93 | |
| 65, 66 | COG0436: Aspartate/tyrosine/aromatic aminotransferase [Pseudomonas aeruginosa C3719] gi|126170242|gb|EAZ55753.1| aspartate transaminase [Pseudomonas aeruginosa C3719] | 84317581 | 6.00E-59 | Pseudomonas aeruginosa C3719 | Pseudomonas aeruginosa polypeptide #3. | ABO84364 | 2.00E-59 | Pseudomonas aeruginosa polypeptide #3. | ABD17818 | 5.00E-52 | 2.6.1.1 | 399 | 132 | 615 | 410 | | |
| 67, 68 | COG0436: Aspartate/tyrosine/aromatic aminotransferase [Pseudomonas aeruginosa | 84317581 | 1.00E-57 | Pseudomonas aeruginosa C3719 | Pseudomonas aeruginosa polypeptide #3. | ABO84364 | 3.00E-58 | Pseudomonas aeruginosa polypeptide #3. | ABD17818 | 4.00E-46 | 2.6.1.1 | 399 | 132 | 615 | 410 | | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | C3719] gi|126170242|gb| EAZ55753.1| aspartate transaminase [Pseudomonas aeruginosa C3719] | | | | | | | | | | | | | | | |
| 69, 70 | COG0436: Aspartate/ tyrosine/ aromatic aminotransferase [Pseudomonas aeruginosa C3719] | 84317581 | 2.00E-58 | Pseudomonas aeruginosa C3719 | Pseudomonas aeruginosa polypeptide #3. | ABO84364 | 5.00E-59 | Pseudomonas aeruginosa polypeptide #3. | ABD17818 | 1.00E-43 | 2.6.1.1 | 399 | 132 | 615 | 410 | | |
| 71, 72 | aspartate transaminase [Pseudomonas aeruginosa C3719] gi|126170242|gb| EAZ55753.1| aspartate aminotransferase [Pseudomonas putida KT2440] | 26990429 | 5.00E-68 | Pseudomonas putida KT2440 | Pseudomonas aeruginosa polypeptide #3. | ABO84364 | 1.00E-57 | Pseudomonas aeruginosa polypeptide #3. | ABD17818 | 5.00E-52 | 2.6.1.1 | 399 | 132 | 0 | 396 | 96 | |
| 73, 74 | aspartate aminotransferase [Pseudomonas putida KT2440] | 26990429 | 3.00E-68 | Pseudomonas putida KT2440 | Pseudomonas aeruginosa polypeptide #3. | ABO84364 | 1.00E-57 | Pseudomonas aeruginosa polypeptide #3. | ABD17818 | 5.00E-52 | 2.6.1.1 | 399 | 132 | 0 | 396 | 96 | |
| 75, 76 | D-alanine transaminase [Oceanobacter sp. RED65] gi|94427424|gb|E AT12402.1| D-alanine transaminase [Oceanobacter sp. RED65] | 94500389 | 1.00E-101 | Oceanobacter sp. RED65 | L. pneumophila protein SEQ ID NO 3367. | AEB37927 | 2.00E-50 | Pseudomonas aeruginosa polypeptide #3. | ABD03911 | 2.5 | 2.6.1.21 | 873 | 290 | 0 | 265 | 57 | |
| 77, 78 | D-alanine transaminase [Oceanobacter sp. RED65] gi|94427424|gb|E AT12402.1| D-alanine | 94500389 | 1.00E-101 | Oceanobacter sp. RED65 | L. pneumophila protein SEQ ID NO 3367. | AEB37927 | 2.00E-50 | Pseudomonas aeruginosa polypeptide #3. | ABD03911 | 2.5 | 2.6.1.21 | 873 | 290 | 0 | 265 | 57 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | transaminase [*Oceanobacter* sp. RED65] | | | | | | | | | | | | | | | | |
| 79, 80 | aspartate aminotransferase [*Pseudomonas putida* KT2440] | 26990429 | 3.00E-64 | *Pseudomonas putida* KT2440 | *Pseudomonas aeruginosa* polypeptide #3. | ABO84364 | 8.00E-54 | *Pseudomonas aeruginosa* polypeptide #3. | ABD17818 | 7.00E-42 | 2.6.1.1 | 396 | 131 | 0 | 396 | 93 | |
| 81, 82 | aspartate aminotransferase [*Pseudomonas putida* KT2440] | 26990429 | 4.00E-66 | *Pseudomonas putida* KT2440 | *Pseudomonas aeruginosa* polypeptide #3. | ABO84364 | 1.00E-55 | *Pseudomonas aeruginosa* polypeptide #3. | ABD17818 | 1.00E-40 | 2.6.1.1 | 396 | 131 | 0 | 396 | 94 | |
| 83, 84 | glutamate-1-semialdehyde 2;1-aminomutase; putative [*Planctomyces maris* DSM 8797] | 149173540 | 1.00E-101 | *Planctomyces maris* DSM 8797 | Bacterial polypeptide #10001. | ADN26446 | 2.00E-93 | Bacterial polypeptide #10001. | ADS58845 | 0.017 | 5.4.3.8 | 1398 | 465 | 0 | 455 | 41 | |
| 85, 86 | aminotransferase; class IV [*Alkalilimnicola ehrlichei* MLHE-1] | 114319339 | 1.00E-69 | *Alkalilimnicola ehrlichei* MLHE-1 | *L. pneumophila* protein SEQ ID NO 3367. | AEB37927 | 1.00E-46 | *Mycobacterium tuberculosis* strain H37Rv genome SEQ ID NO 2. | AAI09682 | 0.62 | 2.6.1.21 | 873 | 290 | 0 | 286 | 46 | |
| 87, 88 | D-alanine transaminase [*Thiobacillus denitrificans* ATCC 25259] | 74316285 | 3.00E-55 | *Thiobacillus denitrificans* ATCC 25259 | *P. stutzeri* 4 D-HPG AT outer forward N-term PCR primer 1. | AEM18040 | 2.0E-49 | DNA clone originating in barley containing SNP sequence #14. | ACL13803 | 9.8 | 2.6.1.21 | 879 | 292 | 0 | 282 | 40 | |
| 89, 90 | aminotransferase; class I and II [*Pseudomonas putida* F1] | 148547264 | 5.00E-66 | *Pseudomonas putida* F1 | *Mycobacterium tuberculosis* strain *Mycobacterium* | ABO84364 | 1.00E-54 | *Pseudomonas aeruginosa* polypeptide #3. | ABD17818 | 4.00E-34 | 2.6.1.1 | 399 | 132 | 0 | 396 | 93 | |
| 91, 92 | aminotransferase; class I and II [*Pseudomonas putida* F1] | 148547264 | 4.00E-65 | *Pseudomonas putida* F1 | *Pseudomonas aeruginosa* polypeptide #3. | ABO84364 | 4.00E-56 | *Pseudomonas aeruginosa* polypeptide #3. | ABD17818 | 3.00E-53 | 2.6.1.1 | 399 | 132 | 0 | 396 | 93 | |
| 93, 94 | aminotransferase; class I and II [*Pseudomonas putida* F1] | 148547264 | 4.00E-65 | *Pseudomonas putida* F1 | *Pseudomonas aeruginosa* polypeptide #3. | ABO84364 | 4.00E-56 | *Pseudomonas aeruginosa* polypeptide #3. | ABD17818 | 8.00E-54 | 2.6.1.1 | 399 | 132 | 0 | 396 | 93 | |
| 95, 96 | aminotransferase; class I and II [*Pseudomonas putida* F1] | 148547264 | 4.00E-65 | *Pseudomonas putida* F1 | *Pseudomonas aeruginosa* polypeptide #3. | ABO84364 | 4.00E-56 | *Pseudomonas aeruginosa* polypeptide #3. | ABD17818 | 8.00E-54 | 2.6.1.1 | 399 | 132 | 0 | 396 | 93 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 97, 98 | aminotransferase; class I and II [Pseudomonas putida F1] | 148547264 | 1.00E-65 | Pseudomonas putida F1 | Pseudomonas aeruginosa polypeptide #3. | ABO84364 | 1.00E-56 | Pseudomonas aeruginosa polypeptide #3. | ABD17818 | 5.00E-55 | 2.6.1.1 | 399 | 132 | 0 | 396 | 93 | |
| 99, 100 | aspartate aminotransferase [Pseudomonas putida KT2440] | 26990429 | 1.00E-65 | Pseudomonas putida KT2440 | Pseudomonas aeruginosa polypeptide #3. | ABO84364 | 3.00E-56 | Pseudomonas aeruginosa polypeptide #3. | ABD17818 | 3.00E-44 | 2.6.1.1 | 393 | 130 | 0 | 396 | 96 | |
| 101, 102 | aspartate aminotransferase [Pseudomonas putida KT2440] | 26990429 | 7.00E-68 | Pseudomonas putida KT2440 | Pseudomonas aeruginosa polypeptide #3. | ABO84364 | 3.00E-57 | Pseudomonas aeruginosa polypeptide #3. | ABD17818 | 8.00E-54 | 2.6.1.1 | 396 | 131 | 0 | 396 | 97 | |
| 103, 104 | aspartate aminotransferase [Pseudomonas putida KT2440] | 26990429 | 5.00E-66 | Pseudomonas putida KT2440 | Pseudomonas aeruginosa polypeptide #3. | ABO84364 | 3.00E-57 | Pseudomonas aeruginosa polypeptide #3. | ABD17818 | 8.00E-60 | 2.6.1.1 | 399 | 132 | 0 | 396 | 95 | |
| 105, 106 | aspartate aminotransferase [Pseudomonas putida KT2440] | 26990429 | 2.00E-66 | Pseudomonas putida KT2440 | Pseudomonas aeruginosa polypeptide #3. | ABO84364 | 1.00E-57 | Pseudomonas aeruginosa polypeptide #3. | ABD17818 | 5.00E-55 | 2.6.1.1 | 399 | 132 | 0 | 396 | 94 | |
| 107, 108 | aminotransferase; class I and II [Pseudomonas putida F1] | 148547264 | 7.00E-65 | Pseudomonas putida F1 | Pseudomonas aeruginosa polypeptide #3. | ABO84364 | 3.00E-55 | Pseudomonas aeruginosa polypeptide #3. | ABD17818 | 8.00E-54 | 2.6.1.1 | 399 | 132 | 0 | 396 | 93 | |
| 109, 110 | aminotransferase; class I and II [Pseudomonas putida F1] | 148547264 | 1.00E-65 | Pseudomonas putida F1 | Pseudomonas aeruginosa polypeptide #3. | ABO84364 | 7.00E-56 | Pseudomonas aeruginosa polypeptide #3. | ABD17818 | 5.00E-49 | 2.6.1.1 | 399 | 132 | 0 | 396 | 93 | |
| 111, 112 | aminotransferase; class I and II [Pseudomonas putida F1] | 148547264 | 3.00E-66 | Pseudomonas putida F1 | Pseudomonas aeruginosa polypeptide #3. | ABO84364 | 1.00E-56 | Pseudomonas aeruginosa polypeptide #3. | ABD17818 | 5.00E-52 | 2.6.1.1 | 393 | 132 | 0 | 396 | 94 | |
| 113, 114 | aminotransferase; class I and II [Pseudomonas putida F1] | 148547264 | 1.00E-65 | Pseudomonas putida F1 | Pseudomonas aeruginosa polypeptide #3. | ABO84364 | 2.00E-56 | Pseudomonas aeruginosa polypeptide #3. | ABD17818 | 3.00E-50 | 2.6.1.1 | 396 | 132 | 0 | 396 | 93 | |
| 115, 116 | aspartate aminotransferase [Pseudomonas putida KT2440] | 26990429 | 1.00E-65 | Pseudomonas putida KT2440 | Pseudomonas aeruginosa polypeptide #3. | ABO84364 | 2.00E-56 | Pseudomonas aeruginosa polypeptide #3. | ABD17818 | 5.00E-52 | 2.6.1.1 | 399 | 130 | 0 | 396 | 96 | |
| 117, 118 | aminotransferase; class I and II [Pseudomonas putida F1] | 148547264 | 4.00E-65 | Pseudomonas putida F1 | Pseudomonas aeruginosa polypeptide #3. | ABO84364 | 4.00E-56 | Pseudomonas aeruginosa polypeptide #3. | ABD17818 | 5.00E-55 | 2.6.1.1 | 399 | 132 | 0 | 396 | 93 | |
| 119, 120 | aminotransferase; class I and II [Pseudomonas putida F1] | 148547264 | 1.00E-65 | Pseudomonas putida F1 | Pseudomonas aeruginosa polypeptide #3. | ABO84364 | 1.00E-56 | Pseudomonas aeruginosa polypeptide #3. | ABD17818 | 5.00E-55 | 2.6.1.1 | 399 | 132 | 0 | 396 | 93 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 121, 122 | aminotransferase; class I and II [Pseudomonas putida F1] aspartate | 148547264 | 4.00E-65 | Pseudomonas putida F1 | Pseudomonas aeruginosa polypeptide #3. | ABO84364 | 4.00E-56 | Pseudomonas aeruginosa polypeptide #3. | ABD17818 | 3.00E-56 | 2.6.1.1 | 399 | 132 | 0 | 396 | 93 | |
| 123, 124 | aminotransferase [Pseudomonas putida KT2440] | 26990429 | 8.00E-66 | Pseudomonas putida KT2440 | Pseudomonas aeruginosa polypeptide #3. | ABO84364 | 2.00E-56 | Pseudomonas aeruginosa polypeptide #3. | ABD17818 | 3.00E-38 | 2.6.1.1 | 399 | 132 | 0 | 396 | 93 | |
| 125, 126 | D-alanine aminotransferase [Streptomyces avermitilis MA-4680] | 29833346 | 4.00E-77 | Streptomyces avermitilis MA-4680 | Escherichia coli aminotransferase ilvE SEQ ID NO 2. | AEK20408 | 2.00E-33 | Bacterial polypeptide #10001. | ADS45796 | 0.038 | 2.6.1.42 | 831 | 132 | 0 | 273 | 57 | |
| 127, 128 | glutamate-1-semialdehyde 2:1-aminomutase; putative [Planctomyces maris DSM 8797] | 149173540 | 1.00E-143 | Planctomyces maris DSM 8797 | Bacterial polypeptide #10001. | ADN26446 | 1.00E-100 | Clone FS-135 DNA sequence SEQ ID NO: 2. | ADH48029 | 1.00E-09 | 5.4.3.8 | 1362 | 132 | 0 | 455 | 55 | |
| 129, 130 | D-alanine aminotransferase [Rhodobacter sphaeroides 2.4.1] | 77465457 | 1.00E-87 | Rhodobacter sphaeroides 2.4.1 | Bacterial polypeptide #19. | ADF03944 | 3.00E-68 | Drosophila melanogaster polypeptide SEQ ID NO 24465. | ABL03211 | 2.4 | 2.6.1.21 | 864 | 132 | 0 | 285 | 57 | |
| 131, 132 | D-Amino Acid Aminotransferase [Bacillus sp. B14905] gi|126591833|gb|EAZ85916.1| D-Amino Acid Aminotransferase [Bacillus sp. B14905] | 126651304 | 1.00E-158 | Bacillus sp. B14905 | P. taetrolens aldolase 2. | ADW43694 | 1.00E-159 | B. sphaericus D-amino-transferase BSDAT SEQ ID NO: 4. | ADP27941 | 0 | 2.6.1.21 | 855 | 284 | 1709 | 284 | | |
| 133, 134 | aminotransferase class-IV [Azoarcus sp. EbN1] | 564771154 | 4.00E-67 | Azoarcus sp. EbN1 | Prokaryotic essential gene #347740. | ABU33175 | 4.00E-45 | M. xanthus protein sequence, seq id 9726. | ACL64145 | 0.16 | 2.6.1.21 | 876 | 291 | 0 | 285 | 45 | |
| 135, 136 | D-alanine aminotransferase [Rhodobacter sphaeroides 2.4.1] | 77465457 | 1.00E-87 | Rhodobacter sphaeroides 2.4.1 | Bacterial polypeptide #19. | ADF03944 | 3.00E-68 | Drosophila melanogaster polypeptide SEQ ID NO 24465. | ABL03211 | 2.4 | 2.6.1.21 | 864 | 287 | 0 | 285 | 57 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 137, 138 | glutamate-1-semialdehyde 2,1-aminomutase; putative [Planctomyces maris DSM 8797] | 149173540 | 1.00E-111 | Planctomyces maris DSM 8797 | Bacterial polypeptide #10001. | ADN26446 | 1.00E-104 | P. cellulosum ambnuticin ambA protein. | AEC75821 | 0.001 | 5.4.3.8 | 1386 | 461 | 0 | 455 | 46 | |
| 139, 140 | glutamate-1-semialdehyde 2,1-aminomutase; putative [Planctomyces maris DSM 8797] | 149173540 | 1.00E-108 | Planctomyces maris DSM 8797 | Bacterial polypeptide #10001. | ADN26446 | 7.00E-99 | Bacterial polypeptide #10001. | ADS57580 | 0.065 | 5.4.3.8 | 1383 | 460 | 0 | 455 | 43 | |
| 141, 142 | Putative D-alanine aminotransferase [Bradyrhizobium sp. ORS278] | 146342961 | 2.00E-71 | Bradyrhizobium sp. ORS278 | Bacterial polypeptide #19. | ADF03944 | 1.00E-61 | N. gonorrhoeae nucleotide sequence SEQ ID 4691. | ABZ41029 | 0.15 | 2.6.1.21 | 855 | 284 | 0 | 286 | 51 | |
| 143, 144 | Aminotransferase, class IV [Robiginitalea biformata HTCC2501] gi|88783620|gb|EAR14791.1| Aminotransferase, class IV [Robiginitalea biformata HTCC2501] | 88806011 | 1.00E-101 | Robiginitalea biformata HTCC2501 | Bacillus D-amino acid aminotransferase | AAY13560 | 2.00E-48 | DNA encoding novel human diagnostic protein #20574. | AAS82939 | 0.66 | 2.6.1.21 | 915 | 304 | 0 | 255 | 57 | |
| 145, 146 | glutamate-1-semialdehyde 2,1-aminomutase; putative [Planctomyces maris DSM 8797] | 149173540 | 1.00E-114 | Planctomyces maris DSM 8797 | Bacterial polypeptide #10001. | ADN26446 | 1.00E-93 | M. xanthus protein sequence, seq id 9726. | ACL64704 | 0.99 | 5.4.3.8 | 1350 | 449 | 0 | 455 | 48 | |
| 147, 148 | aminotransferase class-III [Roseiflexus castenholzii DSM 13941] gi|118014341|gb|EAV28318.1| aminotransferase class-III [Roseiflexus castenholzii DSM 13941] | 118061613 | 1.00E-104 | Roseiflexus castenholzii DSM 13941 | Bacterial polypeptide #10001. | ADN26446 | 2.00E-87 | Glutamate-1-semialdehyde aminotransferase | AAQ63611 | 2.00E-05 | 5.4.3.8 | 1383 | 460 | 0 | 454 | 44 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 149, 150 | glutamate-1-semialdehyde 2,1-aminomutase; putative [Planctomyces maris DSM 8797] | 149173540 | 1.00E-114 | Planctomyces maris DSM 8797 | Bacterial polypeptide #10001. | ADN26446 | 1.00E-90 | Bacterial polypeptide #10001. | ADS57112 | 0.004 | 5.4.3.8 | 1377 | 458 | 0 | 455 | 46 | |
| 151, 152 | D-alanine aminotransferase [Bacillus licheniformis ATCC 14580] | 52079452 | 1.00E-56 | Bacillus licheniformis ATCC 14580 | P. stutzeri 4 D-HPG AT outer forward N-term PCR primer 1. | AEM18039 | 2.00E-56 | Human prostate cancer cDNA #473. | ADE53957 | 2.4 | 2.6.1.21 | 852 | 283 | 0 | 283 | 40 | |
| 153, 154 | glutamate-1-semialdehyde 2,1-aminomutase; putative [Planctomyces maris DSM 8797] | 149173540 | 1.00E-97 | Planctomyces maris DSM 8797 | Bacterial polypeptide #10001. | ADN26446 | 2.00E-74 | M. xanthus protein sequence, seq id 9726 | ACL64518 | 0.24 | 5.4.3.8 | 1269 | 422 | 0 | 455 | 46 | |
| 155, 156 | aminotransferase class-III [Chloroflexus aggregans DSM 9485] gi|117997930|gb|EAV12112.1| aminotransferase class-III [Chloroflexus aggregans DSM 9485] | 118045454 | 1.00E-107 | Chloroflexus aggregans DSM 9485 | Bacterial polypeptide #10001. | ADN26446 | 1.00E-104 | Bacterial polypeptide #10001. | ADT43944 | 3.00E-04 | 5.4.3.8 | 1362 | 453 | 0 | 443 | 46 | |
| 157, 158 | aminotransferase, class IV [Rhodobacterales bacterium HTCC2150] gi|126706255|gb|EBA05345.1| aminotransferase, class IV [Rhodobacterales bacterium HTCC2150] | 126750091 | 2.00E-78 | Rhodobacterales bacterium HTCC2150 | Bacterial polypeptide #19. | ADF03944 | 9.00E-53 | Oligonucleotide for detecting cytosine methylation SEQ ID NO 20311. | ABQ42663 | 2.5 | 2.6.1.21 | 879 | 292 | 0 | 283 | 48 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 159, 160 | hypothetical protein ALPR18298 [*Algoriphagus sp.* PR1] gi|126576766|gb|EAZ81014.1| hypothetical protein ALPR18298 [*Algoriphagus sp.* PR1] | 126646718 | 6.00E-43 | *Algoriphagus sp.* PR1 | prokaryotic essential gene #34740. | ABU18963 | 7.00E-26 | prokaryotic essential gene #34740. | ACA38856 | 0.58 | 2.6.1.42 | 822 | 273 | 0 | 277 | 36 | |
| 161, 162 | D-amino acid aminotransferase, putative [*Roseobacter sp.* MED193] gi|85823158|gb|EAQ43371.1| D-amino acid aminotransferase, putative [*Roseobacter sp.* MED193] | 86140221 | 1.00E-139 | *Roseobacter sp.* MED193 | Bacterial polypeptide #19. | ADF03944 | 5.00E-75 | Bacterial polypeptide #19. | ADS56887 | 2.4 | 2.6.1.21 | 861 | 286 | 0 | 287 | 87 | |
| 163, 164 | glutamate-1-semialdehyde 2,1-aminomutase; putative [*Planctomyces maris* DSM 8797] | 149173540 | 1.00E-105 | *Planctomyces maris* DSM 8797 | Bacterial polypeptide #10001. | ADN26446 | 6.00E-96 | *M. xanthus* protein sequence, seq id 9726. | ACL64750 | 0065 | 5.4.3.8 | 1377 | 458 | 0 | 455 | 44 | |
| 165, 166 | aminotransferase class-III [*Roseiflexus sp.* RS-1] | 148656729 | 1.00E-105 | *Roseiflexus sp.* RS-1 | Bacterial polypeptide #10001. | ADN26446 | 1.00E-95 | Bacterial polypeptide #10001. | ADS63519 | 7.00E-11 | 5.4.3.8 | 1314 | 437 | 0 | 455 | 46 | |
| 167, 168 | D-amino acid aminotransferase [*Clostridium beijerinckii* NCIMB 8052] gi|82726488|gb|EAP61226.1| D-amino acid aminotransferase [*Clostridium beijerinckii* NCIMB 8052] | 82745661 | 8.00E-96 | *Clostridium beijerinckii* NCIMB 8052 | P. stutzeri 4 D-HPG AT outer forward N-term PCR primer 1. | AEM18031 | 2.00E-47 | Drosophila melanogaster polypeptide SEQ ID NO 24465. | ABL03988 | 2.4 | 2.6.1.21 | 861 | 286 | 0 | 282 | 60 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 169, 170 | putative amino acid aminotransferase [Mycobacterium vanbaalenii PYR-1] gi\|119958874\|gb\|ABM15879.1\| putative amino acid aminotransferase [Mycobacterium vanbaalenii PYR-1] | 120406056 | 1.00E-144 | Mycobacterium vanbaalenii PYR-1 | Prokaryolic essential gene #34740. | ABU33708 | 1.00E-124 | Prokaryolic essential gene #34740. | ACA37578 | 2.00E-53 | 4.1.3.38 | 882 | 293 | 0 | 293 | 65 | |
| 171, 172 | D-amino acid aminotransferase [Clostridium beijerincki NCIMB 8052] gi\|82726488\|gb\|E AP61226.1\| D-amino acid aminotransferase [Clostridium beijerincki NCIMB 8052] | 82745661 | 3.00E-99 | Clostridium beijerincki NCIMB 8052 | P. stutzeri 4 D-HPG AT outer forward N-term PCR primer 1. | AEM18031 | 1.00E-47 | Drosophila melanogaster polypeptide SEQ ID NO 24465. | ABL03988 | 2.4 | 2.6.1.21 | 864 | 267 | 0 | 262 | 62 | |
| 173, 174 | D-amino acid aminotransferase [Clostridium beijerincki NCIMB 8052] gi\|82726488\|gb\|E AP61226.1\| D-amino acid aminotransferase [Clostridium beijerincki NCIMB 8052] | 82745661 | 1.00E-98 | Clostridium beijerincki NCIMB 8052 | Mutant Bacillus sphaericus dat protein. | ABB08244 | 2.00E-47 | Fibrotic disorder associated polynucleotide SEQ ID NO 9. | AED18099 | 0.039 | 2.6.1.21 | 861 | 286 | 0 | 282 | 62 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 175, 176 | D-amino acid aminotransferase [*Clostridium beijerincki* NCIMB 8052] gi\|82726488\|gb\|EAP61226.1) D-amino acid aminotransferase [*Clostridium beijerincki* NCIMB 8052] | 82745661 | 7.00E−98 | *Clostridium beijerincki* NCIMB 8052 | Mutant *Bacillus sphaericus* dat protein. | ABB08244 | 1.00E−46 | Human secreted protein sequence encoded by gene 11 SEQ ID NO: 76. | AAF81809 | 0.61 | 2.6.1.21 | 861 | 266 | 0 | 282 | 62 | |
| 177, 178 | aminotransferase class-III [*Roseiflexus castenholzii* DSM 13941] gi\|118014341 \|gb\|EAV28318.1\| aminotransferase class-III [*Roseiflexus castenholzii* DSM 13941] | 118061613 | 1.00E−110 | *Roseiflexus castenholzii* DSM 13941 | Bacterial polypeptide #10001. | ADN26446 | 9.00E−89 | Hyper-thermophile Methanopyrus kandleri protein #26. | ADM27081 | 0.004 | 5.4.3.8 | 1374 | 457 | 0 | 454 | 47 | |
| 179, 180 | D-amino acid aminotransferase [*Bacillus coagulans* 36D1] gi\|124497181\|gb\|EAY44748.1\| D-amino acid aminotransferase [*Bacillus coagulans* 36D1] | 124520974 | 4.00E−54 | *Bacillus coagulans* 36D1 | *Staphylococcus aureus* protein #10. | ABM71198 | 5.00E−54 | Plant full length insert polynudeotide seqid 4980. | ADX27642 | 2.4 | 2.6.1.21 | 855 | 264 | 0 | 288 | 41 | |
| 181, 182 | branched-chain amino acid aminotransferase [*Thermosynechococcus elongatus* BP-1]. | 22299586 | 7.00E−53 | *Thermosynechococcus elongatus* BP-1 | Prokaryolic essential gene #34740. | ABU18055 | 1.00E−47 | Prostate cancer related gene sequence SEQ ID NO: 8120. | ABL61996 | 0.62 | 2.6.1.42 | 876 | 291 | 861 | 286 | 39 | 51 |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 183, 184 | D-alanine aminotransferase [Oceanobacillus iheyensis]. | 23098538 | 2.00E−53 | Oceanobacillus iheyensis | P. stutzeri 4 D-HPG AT outer forward N-term PCR primer 1. | AEM18040 | 1.00E−51 | Plasmid pMRKAd5 HIV-1 gag DNA noncoding sequence SEQ ID NO: 26. | ADY80523 | 2.3 | 2.6.1.21 | 825 | 274 | 867 | 288 | 41 | 51 |
| 185, 186 | D-alanine aminotransferase [Oceanobacillus iheyensis]. | 23098538 | 2.00E−53 | Oceanobacillus iheyensis | P. stutzeri 4 D-HPG AT outer forward N-term PCR primer 1. | AEM18040 | 1.00E−51 | Plasmid pMRKAd5 HIV-1 gag DNA noncoding sequence SEQ ID NO: 26. | ADY80523 | 2.3 | 2.6.1.21 | 825 | 274 | 867 | 288 | 41 | 51 |
| 187, 188 | D-amino acid aminotransferase [Clostridium beijerinckii NCIMB 8052] gi|82726488|gb|EAP61226.1] D-amino acid aminotransferase [Clostridium beijerinckii NCIMB 8052] | 82745661 | 1.00E−96 | Clostridium beijerinckii NCIMB 8052 | P. stutzeri 4 D-HPG AT outer forward N-term PCR primer 1. | AEM18031 | 3.00E−46 | Human repdroductive system related antigen DNA SEQ ID NO: 8114. | AAL04589 | 2.4 | 2.6.1.21 | 861 | 286 | 0 | 282 | 61 | |
| 189, 190 | D-amino acid aminotransferase [Clostridium beijerinckii NCIMB 8052] gi|82726488|gb|EAP61226.1] D-amino acid aminotransferase [Clostridium beijerinckii NCIMB 8052] | 82745661 | 9.00E−98 | Clostridium beijerinckii NCIMB 8052 | Mutant Bacillus sphaericus dat protein. | ABB08244 | 2.00E−49 | Drosophila melanogaster polypeptide SEQ ID NO 24465. | ABL25490 | 0.62 | 2.6.1.21 | 864 | 287 | 0 | 282 | 62 | |
| 191, 192 | D-amino acid aminotransferase [Clostridium beijerinckii NCIMB 8052] gi|82726488|gb|EAP61226.1] D-amino acid | 82745661 | 1.00E−96 | Clostridium beijerinckii NCIMB 8052 | P. stutzeri 4 D-HPG AT outer forward N-term PCR primer 1. | AEM18031 | 3.00E−46 | Human repdroductive system related antigen DNA SEQ ID NO: 8114. | AAL04589 | 2.4 | 2.6.1.21 | 861 | 286 | 0 | 262 | 61 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | aminotransferase [Clostridium beijerinckii NCIMB 8052] | | | | | | | | | | | | | | | | |
| 193, 194 | D-amino acid aminotransferase [Clostridium beijerinckii NCIMB 8052] gi\|82726488\|gb\|E AP61226.1] D-amino acid aminotransferase [Clostridium beijerinckii NCIMB 8052] | 82745661 | 1.00E-96 | Clostridium beijerinckii NCIMB 8052 | P. stutzeri 4 D-HPG AT outer forward N-term PCR primer 1. | AEM18031 | 3.00E-46 | Human reproductive system related antigen DNA SEQ ID NO: 8114. | AAL04589 | 2.4 | 2.6.1.21 | 861 | 286 | 0 | 282 | 61 | |
| 195, 196 | putative D-alanine aminotransferase [Bacillus sp. SG-1] | 149182609 | 1.00E-59 | Bacillus sp. SG-1 | Bacillus D-amino acid aminotransferase. | AAY13560 | 1.00E-57 | Human ovarian cancer DNA marker #5. | ADL41705 | 0.61 | 2.6.1.21 | 858 | 265 | 0 | 282 | 42 | |
| 197, 198 | putative D-alanine aminotransferase [Bacillus sp. SG-1] | 149182609 | 3.00E-57 | Bacillus sp. SG-1 | P. stutzeri 4 D-HPG AT outer forward N-term PCR primer 1. | AEM18039 | 6.00E-56 | P. stutzeri 4 D-HPG AT outer forward N-term PCR primer 1. | AEM18017 | 0.003 | 2.6.1.21 | 858 | 285 | 0 | 282 | 40 | |
| 199, 200 | D-alanine aminotransferase [Bacillus sp. SG-1] | 149182609 | 5.00E-59 | Bacillus sp. SG-1 | Bacillus D-amino acid aminotransferase. | AAY13560 | 1.00E-57 | Bacillus licheniformis genomic sequence tag (GST) #933. | ABK78375 | 2.4 | 2.6.1.21 | 858 | 285 | 0 | 282 | 42 | |
| 201, 202 | D-alanine aminotransferase [Symbiobacterium thermophilum IAM 14863] | 51892468 | 6.00E-57 | Symbiobacterium thermophilum IAM 14863 | Bacillus D-amino acid aminotransferase. | AAY13560 | 2.00E-51 | Photorhabdus luminescens protein sequence #59. | ACF67498 | 0.15 | 2.6.1.21 | 855 | 284 | 0 | 281 | 40 | |
| 203, 204 | PUTATIVE BRANCHED-CHAIN AMINO ACID AMINO-TRANSFERASE (TRANSAMINAS E B) (BCAT), | 3122274 | 2.00E-46 | Methano thermobacter thermautotrophicus | Prokaryotic essential gene #34740. | ABU23351 | 6.00E-42 | Prokaryotic essential gene #34740. | ACA40289 | 0.17 | 2.6.1.42 | 921 | 306 | 0 | 306 | 34 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 205, 206 | D-alanine aminotransferase [Oceanobacillus iheyensis]. | 23098538 | 2.00E-53 | Oceanobacillus iheyensis | P. stutzeri 4 D-HPG AT outer forward N-term PCR primer 1. | AEM18040 | 1.00E-51 | Plasmid pMRKAd5 HIV-1 gag DNA noncoding sequence SEQ ID NO: 26. | ADY80523 | 2.3 | 2.6.1.21 | 825 | 274 | 867 | 288 | 41 | 51 |
| 207, 208 | D-alanine aminotransferase [Oceanobacillus iheyensis]. | 23098538 | 7.00E-51 | Oceanobacillus iheyensis | P. stutzeri 4 D-HPG AT outer forward N-term PCR primer 1. | AEM18040 | 4.00E-50 | Human protein SEQ ID 537. | ABO99281 | 0.15 | 2.6.1.21 | 825 | 274 | 867 | 288 | 40 | 48 |
| 209, 210 | aminotransferase class-III [Roseiflexus castenholzii DSM 13941] gi\|118014341\|gb\|EAV28318.1\| aminotransferase class-III [Roseiflexus castenholzii DSM 13941] | 118061613 | 1.00E-105 | Roseiflexus castenholzii DSM 13941 | Bacterial polypeptide #10001. | ADN26446 | 3.00E-88 | Clone FS3-135 DNA sequence SEQ ID NO: 2 | ADH48029 | 0.001 | 5.4.3.8 | 1374 | 457 | 0 | 454 | 44 | |
| 211, 212 | hypothetical protein CdifQ_04002916 [Clostridium difficile QCD-32g58] | 145952948 | 6.00E-42 | Clostridium difficile QCD-32g58 | Bacterial polypeptide #10001. | ADS43070 | 4.00E-25 | Human polynucleoide SEQ ID NO 13646. | AAI92131 | 0.053 | 2.6.1.9 | 1137 | 378 | 0 | 367 | 29 | |
| 213, 214 | D-amino acid aminotransferase [Clostridium beijerincki NCIMB 8052] gi\|82726488\|gb\|EAP61226.1\| D-amino acid aminotransferase [Clostridium beijerincki NCIMB 8052] | 82745661 | 3.00E-95 | Clostridium beijerincki NCIMB 8052 | P. stutzeri 4 D-HPG AT outer forward N-term PCR primer 1. | AEM18018 | 2.00E-52 | Plant full length insert polynucleotide seqid 4980. | ADX37088 | 0.6 | 2.6.1.21 | 849 | 262 | 0 | 282 | 61 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 215, 216 | aminotransferase class-III [Roseiflexus castenholzii DSM 13941] gi\|118014341\|gb\|EAV28318.1\| aminotransferase class-III [Roseiflexus castenholzii DSM 13941] | 118061613 | 1.00E-116 | Roseiflexus castenholzii DSM 13941 | Bacterial polypeptide #10001. | ADN26446 | 1.00E-102 | Bacterial polypeptide #10001. | ADS57580 | 0.004 | 5.4.3.8 | 1386 | 461 | 0 | 454 | 49 | |
| 217, 218 | D-alanine aminotransferase [Oceanobacillus iheyensis]. | 23098538 | 2.00E-53 | Oceanobacillus iheyensis | P. stutzeri 4 D-HPG AT outer forward N-term PCR primer 1. | AEM18040 | 1.00E-51 | Plasmid pMRKAd5 HIV-1 gag DNA noncoding sequence SEQ ID NO: 26. | ADY80523 | 2.3 | 2.6.1.21 | 825 | 274 | 867 | 288 | 41 | 51 |
| 219, 220 | D-amino acid aminotransferase [Clostridium beijerincki NCIMB 8052] gi\|82726488\|gb\|EAP61226.1\| D-amino acid aminotransferase [Clostridium beijerincki NCIMB 8052] | 82745661 | 3.00E-98 | Clostridium beijerincki NCIMB 8052 | Mutant Bacillus sphaericus dat protein. | ABB08244 | 4.00E-48 | Human secretory polynucleotide SPTM SEQ ID NO 534. | ABZ36033 | 0.16 | 2.6.1.21 | 861 | 286 | 0 | 282 | 62 | |
| 221, 222 | D-alanine aminotransferase [Symbiobacterium thermophilum IAM 14863] | 51892468 | 1.00E-57 | Symbiobacterium thermophilum IAM 14863 | Bacillus D-amino acid aminotransferase. | AAY13560 | 3.00E-54 | Human protein sequence hCP39072. | ACN44196 | 2.3 | 2.6.1.21 | 840 | 279 | 0 | 281 | 43 | |
| 223, 224 | D-alanine aminotransferase [Oceanobacillus iheyensis]. | 23098538 | 3.00E-97 | Oceanobacillus iheyensis | Heat resistant D-amino acid aminotransferase encoding DNA. | ABB06297 | 7.00E-90 | L. salivarius SIA protein gene LSL1401b (partial). | AFB66287 | 0.62 | 2.6.1.21 | 867 | 288 | 867 | 288 | 60 | 63 |
| 225, 226 | D-amino acid aminotransferase [Clostridium beijerincki NCIMB 8052] | 82745661 | 7.00E-97 | Clostridium beijerincki NCIMB 8052 | Mutant Bacillus sphaericus dat protein. | ABB08244 | 6.00E-47 | Fibrotic disorder associated polynucleotide | AED18099 | 0.039 | 2.6.1.21 | 861 | 266 | 0 | 282 | 61 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predic-ted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | gi\|82726488\|gb\|EAP61226.1] D-amino acid aminotransferase [*Clostridium beijerincki* NCIMB 8052] | | | | | | | SEQ ID NO 9. | | | | | | | | | |
| 227, 228 | D-amino acid aminotransferase [*Clostridium beijerincki* NCIMB 8052] gi\|82726488\|gb\|EAP61226.1\| D-amino acid aminotransferase [*Clostridium beijerincki* NCIMB 8052] | 82745661 | 4.00E−98 | *Clostridium beijerincki* NCIMB 8052 | P. stutzeri 4 D-HPG AT outer forward N-term PCR primer 1. | AEM18031 | 9.00E−47 | Fibrotic disorder associated poly-nucleotide SEQ ID NO 9. | AED18099 | 0.61 | 2.6.1.21 | 861 | 286 | 0 | 282 | 62 | |
| 229, 230 | D-amino acid aminotransferase [*Clostridium beijerincki* NCIMB 8052] gi\|82726400\|gb\|EAP61226.1\| D-amino acid aminotransferase [*Clostridium beijerincki* NCIMB 8052] | 82745661 | 3.00E−94 | *Clostridium beijerincki* NCIMB 8052 | Mutant *Bacillus sphaericus* dat protein. | ABB08244 | 9.00E−45 | Fibrotic disorder associated poly-nucleotide SEQ ID NO 9. | AED18099 | 0.62 | 2.6.1.21 | 873 | 290 | 0 | 282 | 60 | |
| 231, 232 | D-amino acid aminotransferase [*Clostridium beijerincki* NCIMB 8052] gi\|82726488\|gb\|EAP61226.1] D-amino acid aminotransferase [*Clostridium beijerincki* NCIMB 8052] | 82745661 | 2.00E−97 | *Clostridium beijerincki* NCIMB 8052 | P. stutzeri 4 D-HPG AT outer forward N-term PCR primer 1. | AEM18031 | 5.00E−48 | Fibrotic disorder associated poly-nucleotide SEQ ID NO 9. | AED18099 | 0.62 | 2.6.1.21 | 864 | 287 | 0 | 282 | 61 | |
| 233, 234 | hypothetical protein ALPR1_18298 [*Algoriphagus sp.* PR1] | 126646718 | 2.00E−43 | *Algoriphagus sp.* PR1 | B. licheniformis butyryl-CoA dehy-drogenase/acy | AEJ13860 | 1.00E−26 | Drosophila melanogaster polypeptide SEQ ID NO 24465. | ABL22310 | 0.58 | 2.6.142 | 822 | 273 | 0 | 277 | 35 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | gi|126576766|gb|EAZ81014.1| hypothetical protein ALPR1_18298 [Algoriphagus sp. PR1] | | | | l-CoA dehydrogenase pro. 1. | | | | | | | | | | | |
| 235, 236 | branched-chain amino acid aminotransferase (ilvE) [Pyrobaculum aerophilum] | 18313971 | 1.00E-43 | Pyrobaculum aerophilum | Aquifex aspartate aminotransferase B DNA. | ABU57358 | 4.00E-44 | Bacterial polypeptide #10001. | ADT43796 | 0.65 | 2.6.1.42 | 906 | 301 | 1992 | 303 | | |
| 237, 238 | d-alanine aminotransferase [Alcanivorax borkumensis SK2] | 110834821 | 1.00E-55 | Alcanivorax borkumensis SK2 | Bacillus D-amino acid aminotransferase. | AAY13560 | 4.00E-55 | Wheat tryptophan decarboxylase. | AAI70509 | 2.3 | 2.6.1.21 | 837 | 278 | 0 | 294 | 44 | |
| 239, 240 | d-alanine aminotransferase [Alcanivorax borkumensis SK2] | 110834821 | 2.00E-54 | Alcanivorax borkumensis SK2 | Bacillus D-amino acid aminotransferase. | AAY13560 | 4.00E-44 | P. stutzeri 4 D-HPG AT outer forward N-term PCR primer 1. | AEM18017 | 0.038 | 2.6.1.21 | 843 | 280 | 870 | 282 | | |
| 241, 242 | D-alanine aminotransferase [Oceanobacillus iheyensis] | 23098538 | 2.00E-53 | Oceanobacillus iheyensis | P. stutzeri 4 D-HPG AT outer forward N-term PCR primer 1. | AEM18040 | 1.00E-51 | Plasmid pMRKAd5 HIV-1 gag DNA noncoding sequence SEQ ID NO: 26. | ADY80523 | 2.3 | 2.6.1.21 | 825 | 274 | 867 | 288 | 41 | 51 |
| 243, 244 | D-alanine aminotransferase [Oceanobacillus iheyensis] | 23098538 | 2.00E-53 | Oceanobacillus iheyensis | P. stutzeri 4 D-HPG AT outer forward N-term PCR primer 1. | AEM18040 | 1.00E-51 | Plasmid pMRKAd5 HIV-1 gag DNA noncoding sequence SEQ ID NO: 26. | ADY80523 | 2.3 | 2.6.1.21 | 825 | 274 | 867 | 288 | 41 | 51 |
| 245, 246 | aromatic amino acid aminotransferase [Pseudomonas entomophila L48] | 104781758 | 1.00E-153 | Pseudomonas entomophila L48 | Klebsiella pneumoniae polypeptide seqid 7178. | ABO61955 | 1.00E-130 | Bacterial polypeptide #10001. | ADS56672 | 2.00E-28 | 2.6.1.57 | 909 | 302 | 0 | 398 | 90 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 247, 248 | D-amino acid aminotransferase [*Clostridium beijerincki* NCIMB 8052] gi\|82726488\|gb\|EAP61226.1\| D-amino acid aminotransferase [*Clostridium beijerincki* NCIMB 8052] | 82745661 | 6.00E−99 | *Clostridium beijerincki* NCIMB 8052 | Mutant *Bacillus sphaericus* dat protein. | ABB08244 | 5.00E−46 | Mouse arylacetamide deacetylase related protein SEQ ID NO: 5. | ABA93421 | 0.61 | 2.6.1.21 | 861 | 286 | 0 | 282 | 62 | |
| 249, 250 | putative aminotransferase [*Thermobifida fusca* YX] | 72162511 | 8.00E−29 | *Thermobifida fusca* YX | *Escherichia coli* amino-transferase ilvE SEQ ID NO 2 | AEK20408 | 4.00E−23 | *M. xanthus* protein sequence, seq id 9726. | ACL64761 | 0.15 | 2.6.1.42 | 837 | 278 | 0 | 280 | 34 | |
| 251, 252 | D-amino-acid dehydrogenase [*Methylobacillus flagellatus* KT] | 91775144 | 6.00E−17 | *Methylo-bacillus flagellatus* KT | Enterobacter cloacae protein amino acid sequence - SEQ ID 5666. | AEH60497 | 5.00E−14 | *P. aeruginosa virulence* gene, VIR14, protein. | ADQ03059 | 8.00E−04 | 1.4.99.1 | 138 | 45 | 0 | 417 | 93 | |
| 253, 254 | D-amino acid dehydrogenase; small chain [*Rhodopirellula baltica* SH 1] | 32473614 | 1.00E−152 | *Rhodo-pirellula baltica* SH 1 | *N. gonorrhoeae* nucleotide sequence SEQ ID 4691. | ABP80542 | 6.00E−46 | Arabidopsis thaliana protein, SEQ ID 1971. | ADA71348 | 0.92 | 1.4.99.1 | 1260 | 419 | 0 | 456 | 61 | |
| 255, 256 | D-amino-acid dehydrogenase [*Burkholderia xenovorans* LB400] | 91779297 | 0 | *Burkholderia xenovorans* LB400 | Glyphosate oxido-reductase gene downstream flanking region. | AAR22262 | 3.00E−48 | Prokaryotic essential gene #34740. | ACA26961 | 0.004 | 1.4.99.1 | 1233 | 410 | 0 | 410 | 84 | |
| 257, 258 | putative D-amino-acid dehydrogenase (DadA-like) [*Bradyrhizobium sp*. ORS278] | 146341475 | 1.00E−174 | *Bradyrhizo-bium sp.* ORS278 | Glyphosate oxido-reductase gene downstream flanking region. | AAR22262 | 3.00E−42 | *M. xanthus* protein sequence, seq id 9726. | ACL70702 | 0.058 | 1.4.99.1 | 1233 | 410 | 0 | 412 | 70 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 259, 260 | D-amino acid dehydrogenase small subunit [Bradyrhizobium japonicum USDA 110] | 27377333 | 1.00E-163 | Bradyrhizobium japonicum USDA 110 | P. aeruginosa virulence gene VIR14, protein. | ADQ03060 | 1.00E-152 | Human ORFX protein sequence SEQ ID NO:19716. | ABN17150 | 4.00E-12 | 1.4.99.1 | 1254 | 417 | 0 | 421 | 66 | |
| 261, 262 | D-amino-acid dehydrogenase [Sinorhizobium medicae WSM419] gi|113726415|gb| EAU07507.1| D-amino-acid dehydrogenase [Sinorhizobium medicae WSM419] | 11871743 | 1.00E-166 | Sinorhizobium medicae WSM419 | Glyphosate oxido-reductase gene downstream flanking region. | AAR22262 | 2.00E-42 | SigA2 without bla gene amplifying PCR primer, SigA2-NotD-P, SEQ ID NO: 52. | AEB45551 | 3.6 | 1... | 1248 | 415 | 0 | 417 | 65 | |
| 263, 264 | D-amino acid dehydrogenase, small subunit [Mesorhizobium loti]. | 13473406 | 1.00E-164 | Mesorhizobium loti | P. aeruginosa virulence gene VIR14, protein. | ADQ03060 | 1.00E-142 | Rhizobium species symbiotic plasmid pNGR234. | AAV30459 | 1.00E-12 | 1.4.99.1 | 1254 | 417 | 1257 | 418 | 66 | 67 |
| 265, 266 | Methylenetetrahydrofolate dehydrogenase (NADP+) [Chromohalobacter salexigens DSM 3043] | 92114170 | 1.00E-112 | Chromohalobacter salexigens DSM 3043 | Bacterial polypeptide #10001. | ADS25020 | 2.00E-97 | Bacterial polypeptide #10001. | ADS63414 | 7.00E-22 | 1.5.1.5 | 747 | 248 | 0 | 287 | 79 | |
| 267, 268 | D-amino acid dehydrogenase small subunit [Bordetella parapertussis 12822] | 33596520 | 1.00E-172 | Bordetella parapertussis 12822 | P. aeruginosa virulence gene VIR14, protein. | ADQ03060 | 7.00E-95 | Enterobacter cloacae protein amino acid sequence - SEQ ID 5666. | AEH3102 | 0.001 | 1.4.99.1 | 1254 | 417 | 0 | 418 | 71 | |
| 269, 270 | D-amino acid dehydrogenase; small subunit [Pseudomonas stutzeri A1501] | 146280878 | 0 | Pseudomonas stutzeri A1501 | P. aeruginosa virulence gene VIR14, protein. | ADQ03060 | 0 | Pseudomonas aeruginosa polypeptide #3. | ABD08815 | 3.00E-90 | 1.4.99.1 | 1299 | 432 | 0 | 432 | 78 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 271, 272 | D-amino-acid dehydrogenase [Ralstonia eutropha JMP134] | 73541345 | 1.00E-144 | Ralstonia eutropha JMP134 | Glyphosate oxido-reductase gene downstream flanking region. | AAR22262 | 6.00E-46 | Ramoplanin biosynthetic ORF 20 protein. | AAL40781 | 0.23 | 1.4.99.1 | 1239 | 412 | 0 | 414 | 59 | |
| 273, 274 | D-amino acid dehydrogenase subunit [Xanthomonas axonopodis pv. citri str. 306]. | 21243478 | 1.00E-106 | Xanthomonas axonopodis pv. citri str. 306 | P. aeruginosa virulence gene VIR14, protein. | ADQ03060 | 3.00E-47 | A. orientalis polyene polyketide ORF 14 protein. | ADY72597 | 0.23 | 1.4.99.1 | 1257 | 418 | 1251 | 416 | 48 | 60 |
| 275, 276 | D-amino acid dehydrogenase [Nitrobacter hamburgensis X14] | 92118208 | 1.00E-174 | Nitrobacter hamburgensis X14 | Glyphosate oxido-reductase gene downstream flanking region. | AAR22262 | 8.00E-54 | M. xanthus protein sequence, seq id 9726. | ACL64753 | 0.92 | 1.4.99.1 | 1254 | 417 | 0 | 433 | 70 | |
| 277, 278 | D-amino acid dehydrogenase [Nitrobacter hamburgensis X14] | 92118208 | 1.00E-170 | Nitrobacter hamburgensis X14 | Glyphosate oxido-reductase gene downstream flanking region. | AAR22262 | 2.00E-56 | Drosophila melanogaster polypeptide SEQ ID NO 24465. | ABL23528 | 0.92 | 1.4.99.1 | 1254 | 417 | 0 | 433 | 69 | |
| 279, 280 | D-amino-acid dehydrogenase [Rhodopseudomonas palustris HaA2] | 86750758 | 1.00E-116 | Rhodopseudomonas palustris HaA2 | Glyphosate oxido-reductase gene downstream flanking region. | AAR22262 | 1.00E-53 | Bacterial polypeptide #10001. | ADS56371 | 3.6 | 1.4.99.1 | 1251 | 416 | 0 | 417 | 50 | |
| 281, 282 | D-amino-acid dehydrogenase [Ralstonia pickettii 12J] gi|121302471|gb|EAX43440.1| | 121530396 | 1.00E-151 | Ralstonia pickettii 12J | Glyphosate oxido-reductase gene downstream flanking region. | AAR22262 | 1.00E-45 | Streptococcus pyogenes protein G, SEQ ID NO: 28. | AEC16041 | 0.058 | 1.4.99.1 | 1242 | 413 | 0 | 416 | 63 | |
| 283, 284 | D-amino acid dehydrogenase [Ralstonia pickettii 12J] D-amino acid dehydrogenase small subunit | 273773333 | 1.00E-158 | Bradyrhizobium japonicum USDA 110 | P. aeruginosa virulence gene VIR14, protein. | ADQ03060 | 1.00E-147 | P. aeruginosa virulence gene VIR14, protein. | ADQ03059 | 4.00E-12 | 1.4.99.1 | 1263 | 420 | 0 | 421 | 62 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 285, 286 | [Bradyrhizobium japonicum USDA 110] D-amino acid dehydrogenase [Flavobacterium sp. MED217] | 86141912 | 2.00E-87 | Flavobacterium sp. MED217 | M. catarrhalis protein #1. | ADL05210 | 9.00E-53 | Human ORF DNA sequence #4. | ABQ98347 | 3.7 | 1.4.99.1 | 1263 | 420 | 0 | 416 | 40 | |
| 287, 288 | D-amino acid dehydrogenase, small chain [Blastopirellula marina DSM 3645] gi|87287337|gb|E AQ79237.1| D-amino acid dehydrogenase, small chain [Blastopirellula marina DSM 3645] | 87309573 | 1.00E-128 | Blastopirellula marina DSM 3645 | Glyphosate oxidoreductase gene downstream flanking region. | AAR22262 | 3.00E-47 | Drosophila melanogaster polypeptide SEQ ID NO 24465. | ABL11756 | 0.92 | 1.4.99.1 | 1257 | 418 | 0 | 416 | 52 | |
| 289, 290 | possible D-amino-acid dehydrogenase [Rhodopseudomonas palustris CGA009] | 39936835 | 1.00E-120 | Rhodopseudomonas palustris CGA009 | Glyphosate oxidoreductase gene downstream flanking region. | AAR22262 | 2.00E-52 | M. xanthus protein sequence, seq id 9726. | ACL64803 | 0.06 | 1.4.99.1 | 1284 | 427 | 0 | 417 | 52 | |
| 291, 292 | D-amino acid dehydrogenase, small chain [Blastopirellula marina DSM 3645] gi|87287337|gb|E AQ79237.1| D-amino acid dehydrogenase, small chain [Blastopirellula marina DSM 3645] | 87309573 | 1.00E-136 | Blastopirellula marina DSM 3645 | P. aeruginosa virulence gene VIR14, protein. | ADQ03060 | 3.00E-42 | Enterobacter cloacae protein amino acid sequence - SEQ ID 5666. | AEH54372 | 0.92 | 1.4.99.1 | 1263 | 420 | 0 | 416 | 56 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 293, 294 | D-amino acid dehydrogenase; small subunit family protein [*Pseudomonas entomophila* L48] | 104781752 | 0 | *Pseudomonas entomophila* L48 | Glyphosate oxido-reductase gene downstream flanking region. | AAR22262 | 1.00E-47 | Arabidopsis thaliana axidative stress-associated protein #12. | ADT06724 | 0.23 | 1.4.99.1 | 1245 | 414 | 0 | 414 | 91 | |
| 295, 296 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 4.00E-86 | *Microscilla marina* ATCC 23134 | Glyphosate oxido-reductase gene downstream flanking region. | AAR22262 | 5.00E-38 | Microscilla furvescens catalase-53CA1 gene. | AAV06555 | 0.24 | 1.4.99.1 | 1296 | 431 | 0 | 427 | 42 | |
| 297, 298 | D-amino acid dehydrogenase; small subunit [*Pseudomonas stutzeri* A1501] | 146284421 | 1.00E-177 | *Pseudomonas stutzeri* A1501 | *Acinetobacter baumannii* protein #19. | ADA36279 | 1.00E-124 | *Acinetobacter baumannii* protein #19. | ADA32153 | 3.6 | 1.4.99.1 | 1242 | 413 | 0 | 419 | 74 | |
| 299, 300 | D-amino acid dehydrogenase; small subunit [*Pseudomonas stutzeri* A1501] | 146284421 | 1.00E-176 | *Pseudomonas stutzeri* A1501 | *Acinetobacter baumannii* protein #19. | ADA36279 | 1.00E-123 | *Acinetobacter baumannii* protein #19. | ADA32153 | 3.6 | 1.4.99.1 | 1242 | 413 | 0 | 419 | 74 | |
| 301, 302 | putative d-amino acid dehydrogenase small subunit [*Rhizobium leguminosarum* bv. viciae 3841] | 116250556 | 1.00E-168 | *Rhizobium leguminosarum* bv. viciae 3841 | Glyphosate oxidoreductase gene downstream flanking region. | AAR22262 | 3.00E-48 | *Pseudomonas aeruginosa* polypeptide #3. | ABD16228 | 0.92 | 1... | 1254 | 417 | 0 | 415 | 66 | |
| 303, 304 | D-amino acid dehydrogenase [*Sphingomonas wittichii* RW1] | 148553731 | 4.00E-90 | *Sphingomonas wittichii* RW1 | P. aeruginosa virulence gene VIR14, protein. | ADQ03060 | 3.00E-87 | Enterobacter cloacae protein amino acid sequence - SEQ ID 5666. | AEH53102 | 0.059 | 1.4.99.1 | 1269 | 422 | 0 | 416 | 42 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 305, 306 | D-amino acid dehydrogenase small subunit [Escherichia coli CFT073] | 26247503 | 0 | Escherichia coli CFT073 | Enterobacter cloacae protein amino acid sequence - SEQ ID 5666. | AEH60497 | 0 | Enterobacter cloacae protein amino acid sequence - SEQ ID 5666. | AEH53102 | 0 | 1.4.99.1 | 1299 | 432 | 0 | 434 | 93 | |
| 307, 308 | putative d-amino acid dehydrogenase small subunit [Rhizobium leguminosarum bv. victiae 3841] | 116250556 | 1.00E−129 | Rhizobium leguminosarum bv. victiae 3841 | Glyphosate oxidoreductase gene downstream flanking region. | AAR22262 | 9.00E−40 | Aspergillus fumigatus essential gene protein #10. | ADR84929 | 0.24 | 1. . . . | 1320 | 439 | 0 | 415 | 51 | |
| 309, 310 | D-amino acid dehydrogenase small subunit, putative [Microscilla marina ATCC 23134] gi|123984082|gb|EAY24455.1| D-amino acid dehydrogenase small subunit, putative [Microscilla marina ATCC 23134] | 124009931 | 5.00E−98 | Microscilla marina ATCC 23134 | H. pylori GHPO 1099 gene. | AAW98270 | 9.00E−48 | Human GPCR protein SEQ ID NO: 68. | ADC87621 | 0.001 | 1.4.99.1 | 1242 | 413 | 0 | 427 | 44 | |
| 311, 312 | D-amino acid dehydrogenase small subunit [Bradyrhizobium japonicum USDA 110] | 273773333 | 0 | Bradyrhizobium japonicum USDA 110 | P. aeruginosa virulence gene VIR14, protein. | ADQ03060 | 1.00E−150 | Klebsiella pneumoniae polypeptide seqid 7178. | ADB01189 | 3.00E−13 | 1.4.99.1 | 1266 | 421 | 0 | 421 | 95 | |
| 313, 314 | D-amino-acid dehydrogenase [Rhodo-pseudomonas palustris HaA2] | 86750758 | 1.00E−119 | Rhodo-pseudomonas palustris HaA2 | Glyphosate oxidoreductase gene downstream flanking region. | AAR22262 | 3.00E−55 | Bacterial polypeptide #10001. | ADS56475 | 3.6 | 1.4.99.1 | 1245 | 414 | 0 | 417 | 52 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 315, 316 | D-amino-acid dehydrogenase [Ralstonia eutropha JMP134] | 73541345 | 1.00E-145 | Ralstonia eutropha JMP134 | Glyphosate oxidoreductase gene downstream flanking region. | AAR22262 | 1.00E-45 | Mycobacterium tuberculosis strain H37Rv genome SEQ ID NO 2. | AAI99682 | 0.058 | 1.4.99.1 | 1236 | 411 | 0 | 414 | 60 | |
| 317, 318 | D-aminoacid dehydrogenase [Flavobacteriales bacterium HTCC2170] gi|88708933|gb|EAR01167.1] D-amino acid dehydrogenase [Flavobacteriales bacterium HTCC2170] | 88712395 | 5.00E-96 | Flavobacteriales bacterium HTCC2170 | M. catarrhalis protein #1. | ADL05210 | 1.00E-43 | Salmonella typhi VexC gene, reverse PCR primer. | ADZ00150 | 0.91 | 1.4.99.1 | 1245 | 414 | 0 | 416 | 43 | |
| 319, 320 | Enoyl-CoA hydratase/isomerase:3-hydroxyacyl-CoA dehydrogenase, 3-hydroxyacyl-CoA dehydrogenase, NAD-binding protein [Rhodobacterales bacterium HTCC2150] gi|126703311|gb|EBA02409.1] Enoyl-CoA hydratase/isomerase:3-hydroxyacyl-CoA dehydrogenase, 3-hydroxyac | 126727316 | 2.00E-96 | Rhodobacterales bacterium HTCC2150 | Bacterial polypeptide #10001. | ADN25932 | 2.00E-77 | Prokaryotic essential gene #34740. | ACA26563 | 0.052 | 1.1.1.35 | 1110 | 369 | 0 | 646 | 47 | |
| 321, 322 | D-amino-acid dehydrogenase [Ralstonia pickettii 12J] gi|121302471|gb|EAX43440.1] D-amino-acid | 121530396 | 1.00E-170 | Ralstonia pickettii 12J | Glyphosate oxidoreductase gene downstream flanking region. | AAR22262 | 1.00E-42 | Prokaryotic essential gene #34740. | ACA26625 | 0.004 | 1.4.99.1 | 1248 | 415 | 0 | 416 | 68 | |

APPENDIX 1-continued

| SEQ ID NO: | NR Description | NR Accession Code | NR Evalue | Geneseq Protein Accession Code | Geneseq Protein Description | NR Organism | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|
| 323, 324 | dehydrogenase [Ralstonia pickettii 12J] D-amino-acid dehydrogenase [Pseudomonas putida GB-1] gi\|126320385\|gb\|EAZ71237.1\| D-amino-acid dehydrogenase [Pseudomonas putida GB-1] | 126355875 | 0 | AAR22262 | Glyphosate oxidoreductase gene downstream flanking region. | Pseudomonas putida GB-1 | Bacterial polypeptide #10001. | ADS56305 | 0.015 | 1.4.99.1 | 1245 | 414 | 0 | 414 | 97 | |
| 325, 326 | D-amino-acid dehydrogenase [Pseudomonas putida GB-1] gi\|126319114\|gb\|EAZ69967.1\| D-amino-acid dehydrogenase [Pseudomonas putida GB-1] | 126356306 | 0 | ADQ03060 | P. aeruginosa virulence gene VIR14, protein. | Pseudomonas putida GB-1 | P. aeruginosa virulence gene VIR14, protein. | ABD08815 | ######## | 1.4.99.1 | 1302 | 433 | 0 | 434 | 98 | |
| 327, 328 | D-amino acid dehydrogenase subunit [Xanthomonas axonopodis pv. citri str. 306] | 21243478 | 1.00E-112 | ADQ03060 | P. aeruginosa virulence gene VIR14, protein. | Xanthomonas axonopodis pv. citri str. 306 | Bacterial polypeptide #10001. | ADT47109 | 0.059 | 1.4.99.1 | 1254 | 417 | 1251 | 416 | 49 | 61 |
| 329, 330 | D-amino acid dehydrogenase [Flavobacteriales bacterium HTCC2170] gi\|88708933\|gb\|EAR01167.1\| D-amino acid dehydrogenase [Flavobacteriales bacterium HTCC2170] | 88712395 | 4.00E-95 | AAW98270 | H. pylori GHPO 1099 gene. | Flavobacteriales bacterium HTCC2170 | Prokaryotic essential gene #34740. | ACA32282 | 0.91 | 1.4.99.1 | 1251 | 416 | 0 | 416 | 43 | |
| 331, 332 | D-amino acid dehydrogenase small subunit [Bradyrhizobium japonicum USDA 110] | 27377333 | 0 | ADQ03060 | P. aeruginosa virulence gene VIR14, protein. | Bradyrhizobium japonicum USDA 110 | Klebsiella pneumoniae polypeptide seqid 7178. | ABD01189 | 1.00E-09 | 1.4.99.1 | 1256 | 421 | 0 | 421 | 79 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 333, 334 | Enoyl-CoA hydratase/isomerase:3-hydroxyacyl-CoA dehydrogenase, 3-hydroxyacyl-CoA dehydrogenase, NAD-binding protein [Rhodobacterales bacterium HTCC2150] gi\|126703311\|gb\|EBA02409.1\| Enoyl-CoA hydratase/isomerase:3-hydroxyacyl-CoA dehydrogenase, 3-hydroxyac | 126727316 | 2.00E-96 | Rhodobacterales bacterium HTCC2150 | Bacterial polypeptide #10001. | ADN25932 | 2.00E-77 | Prokaryotic essential gene #34740. | ACA26563 | 0.052 | 1.1.1.35 | 1110 | 369 | 0 | 648 | 47 | |
| 335, 336 | D-amino-acid dehydrogenase [Ralstonia pickettii 12J] gi\|121302471\|gb\|EAX43440.1\| D-amino-acid dehydrogenase [Ralstonia pickettii 12J] | 121530396 | 1.00E-170 | Ralstonia pickettii 12J | Glyphosate oxidoreductase gene downstream flanking region. | AAR22262 | 1.00E-42 | Prokaryotic essential gene #34740. | ACA26625 | 0.004 | 1.4.99.1 | 1248 | 415 | 0 | 416 | 68 | |
| 337, 338 | D-amino-acid dehydrogenase [Rhodopseudomonas palustris HaA2] | 86750758 | 1.00E-114 | Rhodopseudomonas palustris HaA2 | Glyphosate oxidoreductase gene downstream flanking region. | AAR22262 | 1.00E-50 | Thale cress polypeptide, SEQ ID NO: 32. | AEI59268 | 0.91 | 1.4.99.1 | 1248 | 415 | 0 | 417 | 49 | |
| 339, 340 | D-amino acid dehydrogenase small subunit, putative [Microscilla marina ATCC 23134] gi\|123984082\|gb\|EAY24455.1\| D-amino acid dehydrogenase | 124009931 | 1.00E-100 | Microscilla marina ATCC 23134 | M. catarrhalis protein #1. | ADL05210 | 7.00E-47 | Mouse Tnfrsf6 genomic sequence. | ADC85461 | 0.91 | 1.4.99.1 | 1245 | 414 | 0 | 427 | 42 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | small subunit, putative [*Microscilla marina* ATCC 23134] | | | | | | | | | | | | | | | | |
| 341, 342 | D-amino-acid dehydrogenase [*Ralstonia pickettii* 12J] gi|121302471|gb|EAX43440.1| D-amino-acid dehydrogenase [*Ralstonia pickettii* 12J] | 121530396 | 1.00E-170 | *Ralstonia pickettii* 12J | Glyphosate oxidoreductase gene downstream flanking region. | AAR22262 | 2.00E-42 | Prokaryotic essential gene #34740. | ACA26625 | 0.91 | 1.4.99.1 | 1248 | 415 | 0 | 416 | 68 | |
| 343, 344 | short-chain dehydrogenase/reductase SDR [*Novosphingobium aromaticivorans* DSM 12444] | 146275754 | 2.00E-51 | *Novosphingobium aromaticivorans* DSM 12444 | Bacterial polypeptide #10001. | ADS24609 | 5.00E-26 | Bacterial polypeptide #10001. | ADS58499 | 0.008 | 1.1.1.184 | 693 | 230 | 0 | 228 | 48 | |
| 345, 346 | D-amino acid dehydrogenase [*Maricaulis maris* MCS10] gi|114341114|gb|ABI66394.1| D-amino-acid dehydrogenase [*Maricaulis maris* MCS1Q] | 114570652 | 2.00E-91 | *Maricaulis maris* MCS10 | P. aeruginosa virulence gene VIR14, protein. | ADQ03060 | 4.00E-78 | Human ORFX protein sequence SEQ ID NO: 19716. | ABN17150 | 4.00E-09 | 1.4.99.1 | 1260 | 419 | 0 | 427 | 43 | |
| 347, 348 | D-amino-acid dehydrogenase [*Sinorhizobium medicae* WSM419] gi|113726415|gb|EAU07507.1| D-amino-acid dehydrogenase [*Sinorhizobium medicae* WSM419] | 113871743 | 1.00E-152 | *Sinorhizobium medicae* WSM419 | Glyphosate oxidoreductase gene downstream flanking region. | AAR22262 | 1.00E-48 | *M. xanthus* protein sequence, seq id 9726. | ACL64399 | 0.23 | 1... | 1245 | 414 | 0 | 417 | 63 | |
| 349, 350 | D-amino-acid dehydrogenase [*Rhodopseudomonas | 86750758 | 1.00E-117 | *Rhodopseudomonas palustris* HaA2 | Glyphosate oxidoreductase gene downstream | AAR22262 | 3.00E-55 | *M. xanthus* protein sequence, seq id 9726. | ACL64798 | 0.91 | 1.4.99.1 | 1251 | 416 | 0 | 417 | 51 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | palustris HaA2] | | | | flanking region. | | | | | | | | | | | | |
| 351, 352 | D-amino acid dehydrogenase; small chain [Rhodopirellula baltica SH 1] | 32473614 | 1.00E-155 | Rhodopirellula baltica SH 1 | N. gonorrhoeae nucleotide sequence SEQ ID 4691. | ABP80542 | 2.00E-48 | Plant polypeptide, SEQ ID 5546. | ADT17628 | 0.92 | 1.4.99.1 | 1260 | 419 | 0 | 456 | 61 | |
| 353, 354 | D-amino acid dehydrogenase [Flavobacteriales bacterium HTCC2170] gi|88708933|gb|EAR01167.1| D-amino acid dehydrogenase [Flavobacteriales bacterium HTCC21701 | 88712395 | 1.00E-88 | Flavobacteriales bacterium HTCC2170 | Bacterial polypeptide #19. | ADF07894 | 9.00E-53 | Sorangium cellulosum jerangolid biosynthetic cluster jerB protein. | AED50859 | 0.059 | 1.4.99.1 | 1263 | 420 | 0 | 416 | 40 | |
| 355, 356 | aldehyde dehydrogenase family protein [Myxococcus xanthus DK 1622] | 108761092 | 2.00E-97 | Myxococcus xanthus DK 1622 | Bacterial polypeptide #10001. | ADN25785 | 1.00E-87 | Bacterial polypeptide #10001. | ADS56451 | 8.00E-07 | 1.2.1.39 | 1020 | 339 | 0 | 524 | 55 | |
| 357, 358 | D-amino acid dehydrogenase small subunit, putative [Microscilla marina ATCC 23134] gi|123984082|gb|EAY24455.1| D-amino acid dehydrogenase small subunit, putative [Microscilla marina ATCC 23134] | 124009931 | 1.00E-96 | Microscilla marina ATCC 23134 | M. catarrhalis protein #1. | ADL05210 | 1.00E-42 | Human cancer-associated protein HP13-036.1. | ABD32968 | 0.91 | 1.4.99.1 | 1251 | 416 | 0 | 427 | 40 | |
| 359, 360 | D-amino acid dehydrogenase small subunit [Rhodococcus sp. RHA1] | 111019145 | 1.00E-163 | Rhodococcus sp. RHA1 | C glutamicum coding sequence fragment SEQ ID NO: 1935. | AAG93079 | 1.00E-103 | Klebsiella pneumoniae polypeptide seqid 7178. | ABD00632 | 0.23 | 1.4.99.1 | 1251 | 416 | 0 | 415 | 68 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 361, 362 | D-amino-acid dehydrogenase small subunit [*Rhodococcus sp.* RHA1] | 111019145 | 1.00E-163 | *Rhodococcus sp.* RHA1 | C glutamicum coding sequence fragment SEQ ID NO: 1935. | AAG93079 | 1.00E-103 | *Klebsiella pneumoniae* polypeptide seqid 7178. | ABD00632 | 0.23 | 1.4.99.1 | 1251 | 416 | 0 | 415 | 68 | |
| 363, 364 | D-amino-acid dehydrogenase small subunit [*Rhodococcus sp.* RHA1] | 111019145 | 1.00E-163 | *Rhodococcus sp.* RHA1 | C glutamicum coding sequence fragment SEQ ID NO: 1935. | AAG93079 | 1.00E-103 | *Klebsiella pneumoniae* polypeptide seqid 7178. | ABD00632 | 0.23 | 1.4.99.1 | 1251 | 416 | 0 | 415 | 68 | |
| 365, 366 | D-amino acid dehydrogenase small subunit [*Bradyrhizobium japonicum* USDA 110] | 273773333 | 0 | *Bradyrhizobium japonicum* USDA 110 | P. aeruginosa virulence gene VIR14, protein. | ADQ03060 | 1.00E-149 | *Klebsiella pneumoniae* polypeptide seqid 7178. | ABD01189 | 2.00E-11 | 1.4.99.1 | 1266 | 421 | 0 | 421 | 93 | |
| 367, 368 | D-amino acid dehydrogenase small subunit [*Herminiimonas arsenicoxydans*] gi|133737889|emb|CAL60934.1| D-amino acid dehydrogenase small subunit [*Herminiimonas arsenicoxydans*] | 134093986 | 0 | *Herminiimonas arsenicoxydans* | P. aeruginosa virulence gene VIR14, protein. | ADQ03060 | 1.00E-101 | *Klebsiella pneumoniae* polypeptide seqid 7178. | ABD01189 | 3.00E-07 | 1.4.99.1 | 1317 | 438 | 0 | 443 | 80 | |
| 369, 370 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 1.00E-101 | *Microscilla marina* ATCC 23134 | H. pylori GHPO 1099 gene. | AAW98270 | 1.00E-148 | Soybean polymorphic locus, SEQ ID 6. | AEI27664 | 0.23 | 1.4.99.1 | 1245 | 414 | 0 | 427 | 44 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 371, 372 | D-amino acid dehydrogenase small subunit [Bradyrhizobium japonicum USDA 110] | 27377333 | 0 | Bradyrhizobium japonicum USDA 110 | P. aeruginosa virulence gene VIR14, protein. | ADQ03060 | 1.00E-148 | Rhizobium species symbiotic plasmid pNGR234. | AAV30459 | 1.00E-15 | 1.4.99.1 | 1266 | 421 | 0 | 421 | 94 | |
| 373, 374 | D-amino-acid dehydrogenase [Ralstonia eutropha JMP134] | 73541345 | 1.00E-136 | Ralstonia eutropha JMP134 | Glyphosate oxidoreductase gene downstream flanking region. | AAR22262 | 3.00E-47 | Bacterial polypeptide #10001. | ADS56859 | 0.23 | 1.4.99.1 | 1260 | 419 | 0 | 414 | 57 | |
| 375, 376 | D-amino acid dehydrogenase [Psychroflexus torquis ATCC 700755] gi|91184468|gb|E AS70851.1| D-amino acid dehydrogenase [Psychroflexus torquis ATCC 700755] | 91217360 | 3.00E-98 | Psychroflexus torquis ATCC 700755 | Acinetobacter baumannii protein #19. | ADA33588 | 2.00E-47 | Cyclin-dependent kinase modulation biomarker SEQ ID NO 24. | ADX06332 | 3.6 | 1.4.99.1 | 1257 | 418 | 0 | 415 | 43 | |
| 377, 378 | D-amino acid dehydrogenase [Flavobacteriales bacterium HTCC2170] gi|88708933|gb|E AR01167.1| D-amino acid dehydrogenase [Flavobacteriales bacterium HTCC2170] | 88712395 | 1.00E-122 | Flavobacteriales bacterium HTCC2170 | M. catarrhalis protein #1. | ADL05210 | 4.00E-40 | Human immune/ haemato-poietic antigen genomic sequence SEQ ID NO: 41436. | AAK69489 | 0.23 | 1.4.99.1 | 1245 | 414 | 0 | 416 | 51 | |
| 379, 380 | D-amino-acid dehydrogenase [Maricaulis maris MCS10] gi|114341114|gb| AB166394.1| D-amino-acid dehydrogenase [Maricaulis maris MCS1Q] | 114570652 | 8.00E-91 | Maricaulis maris MCS10 | P. aeruginosa virulence gene VIR14, protein. | ADQ03060 | 6.00E-78 | B. circulans putative CapJ protein. | AED48875 | 0.015 | 1.4.99.1 | 1257 | 418 | 0 | 427 | 43 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 381, 382 | D-amino-acid dehydrogenase small subunit [*Rhodococcus sp. RHA1*] | 111019145 | 1.00E-163 | *Rhodococcus sp. RHA1* | C glutamicum coding sequence fragment SEQ ID NO: 1935. | AAG93079 | 1.00E-103 | *Klebsiella pneumoniae* polypeptide seqid 7178. | ABD00632 | 0.23 | 1.4.99.1 | 1251 | 416 | 0 | 415 | 68 | |
| 383, 384 | D-amino acid dehydrogenase, small subunit [*Mesorhizobium loti*]. | 13473406 | 0 | *Mesorhizobium loti* | P. aeruginosa virulence gene VIR14, protein. | ADQ03060 | 1.00E-140 | P. aeruginosa virulence gene VIR14, protein. | ADQ03059 | 7.00E-11 | 1.4.99.1 | 1260 | 419 | 1257 | 418 | 88 | 87 |
| 385, 386 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 5.00E-99 | *Microscilla marina* ATCC 23134 | H. pylori GHPO 1099 gene. | AAW98270 | 1.00E-47 | Human nervous system related polynucleotide SEQ ID NO 11589. | ABA19863 | 0.91 | 1.4.99.1 | 1245 | 414 | 0 | 427 | 42 | |
| 387, 388 | D-amino acid dehydrogenase, small subunit [*Mesorhizobium loti*]. | 13474742 | 0 | *Mesorhizobium loti* | *Pseudomonas aeruginosa* polypeptide #3. | ABO75104 | 2.00E-90 | M. tuberculosis recombinant antigen DNA encoding 3' XP32 | AAZ19073 | 0.91 | 1.4.99.1 | 1251 | 416 | 1251 | 416 | 75 | 74 |
| 389, 390 | D-amino acid dehydrogenase small subunit [*Herminiimonas arsenicoxydans*] gi|133737889|emb|CAL60934.1| D-amino acid dehydrogenase small subunit [*Herminiimonas arsenicoxydans*] | 134093986 | 0 | *Herminiimonas arsenicoxydans* | *Klebsiella pneumoniae* polypeptide seqid 7178. | ABO67618 | 2.00E-95 | *Klebsiella pneumoniae* polypeptide seqid 7178. | ABD01189 | 2.00E-08 | 1.4.99.1 | 1317 | 438 | 0 | 443 | 80 | |
| | | 87309573 | 1.00E-139 | *Blasto-* | N. | ABP80542 | 1.00E-44 | Myco- | ADB80216 | 0.92 | 1.4.99.1 | 1257 | 418 | 0 | 416 | 55 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 391, 392 | D-amino acid dehydrogenase, small chain [*Blastopirellula marina* DSM 3645] gi|87287337|gb|EAQ79237.1| D-amino acid dehydrogenase, small chain [*Blastopirellula marina* DSM 3645] | | | | | *gonorrhoeae* nucleotide sequence SEQ ID 4691. | | | bacterium tuberculosis nutrient starvation-inducible protein #8. | | | | | | | | |
| 393, 394 | probable D-amino acid dehydrogenase small subunit [*Azoarcus sp.* BH72] | 119897258 | 1.00E-111 | *Azoarcus sp.* BH72 | *Pseudomonas aeruginosa* polypeptide #3. | ABO84309 | 1.00E-74 | Enterobacter cloacae protein amino acid sequence - SEQ ID 5666. | AEH53102 | 0.001 | 1.4.99.1 | 1257 | 418 | 0 | 416 | 51 | |
| 395, 396 | D-amino acid dehydrogenase [*Ralstonia eutropha* JMP134] | 73541345 | 0 | *Ralstonia eutropha* JMP134 | Glyphosate oxidoreductase gene downstream flanking region. | AAR22262 | 1.00E-45 | Plant full length insert polynuceotide seqid 4980. | ADX30055 | 0.058 | 1.4.99.1 | 1242 | 413 | 0 | 414 | 88 | |
| 397, 398 | D-aminoacid dehydrogenase [*Rhodopseudomonas palustris* HaA2] | 86750758 | 1.00E-121 | *Rhodopseudomonas palustris* HaA2 | Glyphosate oxidoreductase gene downstream flanking region. | AAR22262 | 1.00E-56 | Bacterial polypeptide #10001. | ADT43936 | 0.015 | 1.4.99.1 | 1245 | 414 | 0 | 417 | 52 | |
| 399, 400 | D-amino acid dehydrogenase small subunit, putative [*Microscilla marina* ATCC 23134] gi|123984082|gb|EAY24455.1| D-amino acid dehydrogenase small subunit, putative [*Microscilla marina* ATCC 23134] | 124009931 | 2.00E-97 | *Microscilla marina* ATCC 23134 | H. pylori GHPO 1099 gene. | AAW98270 | 1.00E-45 | Human ovarian cancer DNA marker #5. | ADL62778 | 0.23 | 1.4.99.1 | 1242 | 413 | 0 | 427 | 44 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 401, 402 | D-amino-acid dehydrogenase [*Maricaulis maris* MCS10] gi\|114341114\|gb\|ABI66394.1\| D-amino-acid dehydrogenase [*Maricaulis maris* MCS1Q] | 114570652 | 3.00E-66 | *Maricaulis maris* MCS1Q | M. catarrhalis protein #1. | ADL05210 | 9.00E-56 | A. thaliana transcription factor G207 homolog, G227 cDNA. | AAD06652 | 3.6 | 1.4.99.1 | 1250 | 419 | 0 | 427 | 33 | |
| 403, 404 | D-amino acid dehydrogenase small subunit, putative [*Microscilla marina* ATCC 23134] gi\|123984082\|gb\|EAY24455.1\| D-amino acid dehydrogenase small subunit, putative [*Microscilla marina* ATCC 23134] | 124009931 | 1.00E-111 | *Microscilla marina* ATCC 23134 | H. pylori GHPO 1099 gene. | AAW98270 | 3.00E-46 | A. fumigatus AfGOX3. | ABQ80343 | 3.6 | 1.4.99.1 | 1257 | 418 | 0 | 427 | 47 | |
| 405, 406 | D-amino acid dehydrogenase [*Robiginitalea biformata* HTCC2501] gi\|88783849\|gb\|EAR15020.1\| | 88806240 | 2.00E-95 | *Robiginitalea biformata* HTCC2501 | Glyphosate oxidoreductase gene downstream flanking region. | AAR22262 | 3.00E-45 | Human 7a5 prognostin protein sequence SeqID2. | ADW91994 | 0.91 | 1.4.99.1 | 1239 | 412 | 0 | 417 | 42 | |
| 407, 408 | D-amino acid dehydrogenase small subunit [*Bradyrhizobium japonicum* USDA 110] | 273777333 | 0 | *Bradyrhizobium japonicum* USDA 110 | P. aeruginosa virulence gene VIR14, protein. | ADQ03060 | 1.00E-149 | *Klebsiella pneumoniae* polypeptide seqid 7178. | ABD01189 | 2.00E-11 | 1.4.99.1 | 1266 | 421 | 0 | 421 | 94 | |
| 409, 410 | D-amino acid dehydrogenase small subunit, putative | 124009931 | 2.00E-98 | *Microscilla marina* ATCC 23134 | P. aeruginosa virulence gene VIR14, | ADQ03060 | 4.00E-52 | Human soft tissue sarcoma-upregulated | ADQ18897 | 0.92 | 1.4.99.1 | 1260 | 419 | 0 | 427 | 45 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | [Microscilla marina ATCC 23134] gi|123984082|gb|EAY24455.1| D-amino acid dehydrogenase small subunit, putative [Microscilla marina ATCC 23134] | | | | protein. | | | protein - SEQ ID 40. | | | | | | | | | |
| 411, 412 | ketoglutarate semialdehyde dehydrogenase [Pseudomonas entomophila L48] | 104783034 | 1.00E-103 | Pseudomonas entomophila L48 | Bacterial polypeptide #10001. | ADN25785 | 1.00E-103 | Bacterial polypeptide #10001. | ADS55665 | 4.00E-09 | 1.2.1.4 | 1242 | 413 | 0 | 526 | 50 | |
| 413, 414 | D-amino acid dehydrogenase [Rhodopseudomonas palustris HaA2] | 86750758 | 1.00E-119 | Rhodopseudomonas palustris HaA2 | Glyphosate oxidoreductase gene downstream flanking region. | AAR22262 | 3.00E-57 | Prokaryotic essential gene #34740. | ACA25332 | 0.23 | 1.4.99.1 | 1248 | 415 | 0 | 417 | 52 | |
| 415, 416 | D-amino acid dehydrogenase [Rhodopseudomonas palustris HaA2] | 86750758 | 1.00E-125 | Rhodopseudomonas palustris HaA2 | Glyphosate oxidoreductase gene downstream flanking region. | AAR22262 | 1.00E-47 | Drosophila melanogaster polypeptide SEQ ID NO 24465. | ABL20166 | 0.015 | 1.4.99.1 | 1242 | 413 | 0 | 417 | 53 | |
| 417, 418 | AGR_L_3050p [Agrobacterium tumefaciens]. | 15891640 | 1.00E-179 | Agrobacterium tumefaciens | P. aeruginosa virulence gene VIR14, protein. | ADQ03060 | 1.00E-150 | E. coli K12 MG1655 biochip probe SEQ ID 1. | ACD81455 | 3.00E-10 | 1.4.99.1 | 1248 | 415 | 1257 | 418 | 73 | 73 |
| 419, 420 | D-amino acid dehydrogenase [Polaromonas sp. JS666] | 91786059 | 0 | Polaromonas sp. JS666 | Photorhabdus luminescens protein sequence #59. | ABM69115 | 1.00E-84 | P. aeruginosa virulence gene VIR14, protein. | ADQ03059 | 2.00E-05 | 1.4.99.1 | 1326 | 441 | 0 | 445 | 76 | |
| 421, 422 | D-amino acid dehydrogenase [Rubrobacter xylanophilus DSM 9941] | 108804652 | 1.00E-108 | Rubrobacter xylanophilus DSM 9941 | C glutamicum coding sequence fragment SEQ ID NO: 1935. | AAG93079 | 8.00E-81 | Prokaryotic essential gene #34740. | ACA37735 | 0.24 | 1.4.99.1 | 1293 | 430 | 0 | 419 | 49 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 423, 424 | D-amino acid dehydrogenase small subunit, putative [*Microscilla marina* ATCC 23134] gi|123984082|gb| EAY24455.1| D-amino acid dehydrogenase small subunit, putative [*Microscilla marina* ATCC 23134] | 124009931 | 4.00E-94 | *Microscilla marina* ATCC 23134 | H. pylori GHPO 1099 gene. | AAW98270 | 4.00E-44 | Chemically treated cell signalling DNA sequence#234. | ABL70446 | 0.91 | 1.4.99.1 | 1245 | 414 | 0 | 427 | 43 | |
| 425, 426 | D-amino-acid dehydrogenase [*Ralstonia pickettii* 12J] gi|121302471|gb| EAX43440.1| D-amino-acid dehydrogenase [*Ralstonia pickettii* 12J] | 121530396 | 1.00E-122 | *Ralstonia pickettii* 12J | Glyphosate oxidoreductase gene downstream flanking region. | AAR22262 | 2.00E-44 | Plant cDNA #31. | ADJ44795 | 0.92 | 1.4.99.1 | 1260 | 419 | 0 | 416 | 53 | |
| 427, 428 | D-amino-acid dehydrogenase [*Nitrobacter hamburgensis* X14] | 92118208 | 0 | *Nitrobacter hamburgensis* X14 | Glyphosate oxidoreductase gene downstream flanking region. | AAR22262 | 2.00E-49 | Bacterial polypeptide #10001. | ADS57588 | 0.92 | 1.4.99.1 | 1254 | 417 | 0 | 433 | 72 | |
| 429, 430 | D-amino acid dehydrogenase small subunit, putative [*Microscilla marina* ATCC 23134] gi|123984082|gb| EAY24455.1| D-amino acid dehydrogenase small subunit, putative [*Microscilla marina* ATCC 23134] | 124009931 | 2.00E-97 | *Microscilla marina* ATCC 23134 | Glyphosate oxidoreductase gene downstream flanking region. | AAR22262 | 4.00E-48 | Haemophilus influenzae complete genome sequence. | AAT42063 | 0.059 | 1.4.99.1 | 1263 | 420 | 0 | 427 | 44 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 431, 432 | D-amino acid dehydrogenase small subunit, putative [Microscilla marina ATCC 23134] gi\|123984082\|gb\|EAY24455.1\| D-amino acid dehydrogenase small subunit, putative [Microscilla marina ATCC 23134] | 124009931 | 1.00E-119 | Microscilla marina ATCC 23134 | Glyphosate oxidoreductase gene downstream flanking region. | AAR22262 | 2.00E-49 | Lactic acid bacteria Lactobacillus johnsonii La1 genomic DNA SEQ ID NO: 1. | ADF77343 | 0.91 | 1.4.99.1 | 1242 | 413 | 0 | 427 | 49 | |
| 433, 434 | D-amino acid dehydrogenase [Rhodopseudomonas palustris HaA2] | 86750758 | 1.00E-123 | Rhodopseudomonas palustris HaA2 | Glyphosate oxidoreductase gene downstream flanking region. | AAR22262 | 4.00E-45 | Drosophila melanogaster modified translational start site DNA. | AEF68383 | 0.23 | 1.4.99.1 | 1245 | 414 | 0 | 417 | 52 | |
| 435, 436 | D-amino acid dehydrogenase [Rhodopseudomonas palustris HaA2] | 86750758 | 1.00E-121 | Rhodopseudomonas palustris HaA2 | Glyphosate oxidoreductase gene downstream flanking region. | AAR22262 | 3.00E-41 | Human MDDT protein SEQ ID NO: 2. | ADB80390 | 0.92 | 1.4.99.1 | 1254 | 417 | 0 | 417 | 51 | |
| 437, 438 | carbon monoxide dehydrogenase G protein; putative [Silicibacter pomeroyi DSS-3] | 56697247 | 1.00E-66 | Silicibacter pomeroyi DSS-3 | Bacterial polypeptide #10001. | ADS27598 | 0.12 | Rice abiotic stress responsive polypeptide SEQ ID NO: 4152. | ACL28407 | 1.2 | 1.2.99.2 | 453 | 150 | 0 | 150 | 84 | |
| 439, 440 | carbon monoxide dehydrogenase F protein [Silicibacter pomeroyi DSS-3] | 56697248 | 1.00E-87 | Silicibacter pomeroyi DSS-3 | DNA encoding novel human diagnostic protein #20574. | ABG25235 | 9.00E-09 | Bacterial polypeptide #10001. | ADS63732 | 2.2 | | 780 | 259 | 0 | 260 | 64 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 441, 442 | carbon monoxide dehydrogenase E protein [Silicibacter pomeroyi DSS-3] | 56697249 | 1.00E-171 | Silicibacter pomeroyi DSS-3 | Human adhesion molecule protein AD6/CAA17374.11 | AAU75888 | 3.00E-25 | Neisseria PCR primer SEQ ID NO 1078. | AEB49411 | 0.22 | | 1182 | 393 | 0 | 393 | 76 | |
| 443, 444 | D-amino-acid dehydrogenase [Sinorhizobium medicae WSM419] gi|113726415|gb|EAU07507.1| | 113871743 | 1.00E-150 | Sinorhizobium medicae WSM419 | Glyphosate oxidoreductase gene downstream flanking region. | AAR22262 | 4.00E-55 | Prokaryotic essential gene #34740. | ACA26463 | 0.06 | 1... | 1272 | 423 | 0 | 417 | 61 | |
| 445, 446 | D-amino-acid dehydrogenase [Sinorhizobium medicae WSM419] D-amino acid dehydrogenase [Algoriphagus sp. PR1] gi|126578095|gb|EAZ82315.1| D-amino acid dehydrogenase [Algoriphagus sp. PR1] | 126646463 | 1.00E-175 | Algoriphagus sp. PR1 | H. pylori GHPO 1099 gene. | AAW98270 | 1.00E-45 | Tp1 peptide fragment SEQ ID NO: 78. | AEK18770 | 0.015 | 1.4.99.1 | 1245 | 414 | 0 | 415 | 69 | |
| 447, 448 | D-amino-acid dehydrogenase [Stenotrophomonas maltophilia R551-3] gi|119820020|gb|EAX22641.1| D-amino-acid dehydrogenase [Stenotrophomonas maltophilia R551-3] | 119877440 | 0 | Stenotrophomonas maltophilia R551-3 | P. aeruginosa virulence gene VIR14, protein. | ADQ03060 | 0 | Pseudomonas aeruginosa polypeptide #3. | ABD08815 | 4.00E-37 | 1.4.99.1 | 1308 | 435 | 0 | 434 | 84 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 449, 450 | D-amino-acid dehydrogenase [Ralstonia pickettii 12J] gi|121302471|gb|EAX43440.1| D-amino-acid dehydrogenase [Ralstonia pickettii 12J] | 121530396 | 1.00E-104 | Ralstonia pickettii 12J | Glyphosate oxidoreductase gene downstream flanking region. | AAR22262 | 9.00E-37 | Pseudomonas aeruginosa polypeptide #3. | ABD03414 | 0.015 | 1.4.99.1 | 1248 | 415 | 0 | 416 | 48 | |
| 451, 452 | D-amino-acid dehydrogenase [Ralstonia pickettii 12J] gi|121302471|gb|EAX43440.1| D-amino-acid dehydrogenase [Ralstonia pickettii 12J] | 121530396 | 1.00E-143 | Ralstonia pickettii 12J | Glyphosate oxidoreductase gene downstream flanking region. | AAR22262 | 2.00E-49 | Prokaryotic essential gene #34740. | ACA23380 | 0.23 | 1... | 1245 | 414 | 0 | 416 | 62 | |
| 453, 454 | D-amino-acid dehydrogenase [Sinorhizobium medicae WSM419] gi|113726415|gb|EAU07507.1| D-amino-acid dehydrogenase [Sinorhizobium medicae WSM419] | 113871743 | 1.00E-125 | Sinorhizobium medicae WSM419 | Glyphosate oxidoreductase gene downstream flanking region. | AAR22262 | 9.00E-37 | Human ORFX protein sequence SEQ ID NO: 19716. | ABN24675 | 0.92 | 1... | 1254 | 417 | 0 | 417 | 53 | |
| 455, 456 | D-amino acid dehydrogenase small subunit, putative [Microscilla marina ATCC 23134] gi|123984082|gb|EAY24455.1| D-amino acid dehydrogenase small subunit, putative [Microscilla marina ATCC 23134] | 124009931 | 1.00E-104 | Microscilla marina ATCC 23134 | H. pylori GHPO 1099 gene. | AAW98270 | 2.00E-50 | Human IMAGE 249058 DNA corresponding to AW006742. | ACA64961 | 0.91 | 1.4.99.1 | 1242 | 413 | 0 | 427 | 45 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 457, 458 | D-amino acid dehydrogenase [Flavobacteriales bacterium HTCC2170] gi|88708933|gb|EAR01167.1| D-amino acid dehydrogenase [Flavobacteriales bacterium HTCC2170] | 88712395 | 1.00E-173 | Flavobacteriales bacterium HTCC2170 | M. catarrhalis protein #1. | ADL05210 | 2.00E-48 | Drosophila melanogaster polypeptide SEQ ID NO 24465. | ABL10568 | 0.23 | 1.4.99.1 | 1251 | 416 | 0 | 416 | 68 | |
| 459, 460 | D-amino acid dehydrogenase small subunit [Marinobacter sp. ELB17] gi|126629543|gb|EBA00161.1| D-amino acid dehydrogenase small subunit [Marinobacter sp. ELB17] | 126666221 | 0 | Marinobacter sp. ELB17 | Acinetobacter baumannii protein #19. | ADA36279 | 1.00E-129 | Drosophila melanogaster polypeptide SEQ ID NO 24465. | ABL12550 | 3.7 | 1.4.99.1 | 1266 | 421 | 0 | 410 | 78 | |
| 461, 462 | Short-chain dehydrogenase/reductase SDR [Azotobacter vinelandii AvOP] | 67154056 | 1.00E-109 | Azotobacter vinelandii AvOP | Klebsiella pneumoniae polypeptide seqid 7178. | ABO66363 | 1.00E-104 | Klebsiella pneumoniae polypeptide seqid 7178. | ACH99914 | 6.00E-04 | 1... | 762 | 253 | 0 | 254 | 76 | |
| 463, 464 | D-amino acid dehydrogenase [Psychroflexus torquis ATCC 700755] gi|91184468|gb|EAS70851.1| D-amino acid dehydrogenase [Psychroflexus torquis ATCC 700755] | 91217360 | 1.00E-167 | Psychroflexus torquis ATCC 700755 | H. pylori GHPO 1099 gene. | AAW98270 | 2.00E-52 | Novel human protein sequence #4. | ADQ64455 | 0.23 | 1.4.99.1 | 1248 | 415 | 0 | 415 | 69 | |
| 465, 466 | D-amino acid dehydrogenase [Geobacillus kaustophilus HTA426] | 56420489 | 4.00E-18 | Geobacillus kaustophilus HTA426 | Hyperthermophile Methanopyrus kandleri protein #28. | ADM25691 | 6.00E-11 | AB005287 cDNA clone. | AAC90078 | 8.00E-05 | 1.1.1.95 | 447 | 148 | 0 | 334 | 34 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 467, 468 | D-amino-acid dehydrogenase [Ralstonia eutropha JMP134] | 73541345 | 1.00E-133 | Ralstonia eutropha JMP134 | Glyphosate oxidoreductase gene downstream flanking region. | AAR22262 | 1.00E-38 | Thale cress polypeptide, SEQ ID NO: 32. | AEI59858 | 0.23 | 1.4.99.1 | 1242 | 413 | 0 | 414 | 55 | |
| 469, 470 | putative d-amino acid dehydrogenase small subunit [Rhizobium leguminosarum bv. viciae 3841] | 116250556 | 1.00E-166 | Rhizobium leguminosarum bv. viciae 3841 | Glyphosate oxidoreductase gene downstream flanking region. | AAR22262 | 5.00E-46 | Murine cancer-associated genomic DNA #5. | ADZ13449 | 0.91 | 1... | 1245 | 414 | 0 | 415 | 66 | |
| 471, 472 | D-amino acid dehydrogenase small subunit [Escherichia coli CFT073] | 26247503 | 0 | Escherichia coli CFT073 | Enterobacter cloacae protein amino acid sequence - SEQ ID 5666. | AEH60497 | 0 | DNA encoding novel human diagnostic protein #20574. | AAS77111 | 0 | 1.4.99.1 | 1299 | 432 | 0 | 434 | 100 | |
| 473, 474 | D-amino-acid dehydrogenase [Sinorhizobium medicae WSM419] gi|113726415|gb|EAU07507.1| D-amino-acid dehydrogenase [Sinorhizobium medicae WSM419] | 113871743 | 1.00E-159 | Sinorhizobium medicae WSM419 | Glyphosate oxidoreductase gene downstream flanking region. | AAR22262 | 3.00E-47 | G sorghi nitrilase protein fragment #2. | ACF04822 | 0.91 | 1... | 1248 | 415 | 0 | 417 | 64 | |
| 475, 476 | D-amino-acid dehydrogenase [Maricaulis maris MCS10] gi|114341114|gb|ABI66394.1| D-amino-acid dehydrogenase [Maricaulis maris MCS10] | 114570652 | 1.00E-155 | Maricaulis maris MCS10 | P. aeruginosa virulence gene VIR14, protein. | ADQ03060 | 4.00E-75 | S ambofaciens spiramycin biosynthetic enzyme encoded by ORF10*. | ADN97550 | 0.25 | 1.4.99.1 | 1341 | 446 | 0 | 427 | 62 | |
| 477, 478 | D-amino acid dehydrogenase [Flavobacteriales bacterium HTCC2170] gi|88708933|gb|E | 88712395 | 4.00E-85 | Flavobacteriales bacterium HTCC2170 | P. aeruginosa virulence gene VIR14, protein. | ADQ03060 | 3.00E-51 | Human protein sequence hCP39072. | ACN44608 | 0.001 | 1.4.99.1 | 1239 | 412 | 0 | 416 | 38 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | AR01167.11 D-amino acid dehydrogenase [Flavobacteriales bacterium HTCC2170] | | | | | | | | | | | | | | | | |
| 479, 480 | D-amino acid dehydrogenase [Flavobacteriales bacterium HTCC2170] gi|88708933|gb|E AR01167.11 D-amino acid dehydrogenase [Flavobacteriales bacterium HTCC2170] | 88712395 | 4.00E-85 | Flavobacteriales bacterium HTCC2170 | P. aeruginosa virulence gene VIR14, protein. | ADQ03060 | 3.00E-51 | Human protein sequence hCP39072. | ACN44608 | 0.001 | 1.4.99.1 | 1239 | 412 | 0 | 416 | 38 | |
| 481, 482 | D-amino acid dehydrogenase [Flavobacteriales bacterium HTCC2170] gi|88708933|gb|E AR01167.1] D-amino acid dehydrogenase [Flavobacteriales bacterium HTCC2170] | 88712395 | 1.00E-175 | Flavobacteriales bacterium HTCC2170 | M. catarrhalis protein #1. | ADL05210 | 3.00E-50 | Human MP53 protein sequence SEQ ID NO: 69. | ADF69167 | 0.059 | 1.4.99.1 | 1251 | 416 | 0 | 416 | 69 | |
| 483, 484 | D-amino acid dehydrogenase small subunit [Herminiimonas arsenicoxydans] gi|133737889|em b|CAL60934.1| | 134093986 | 0 | Herminiimonas arsenicoxydans | P. aeruginosa virulence gene VIR14, protein. | ADQ03060 | 4.00E-94 | Pseudomonas aeruginosa polypeptide #3. | ABD08815 | 0.001 | 1.4.99.1 | 1311 | 436 | 0 | 443 | 82 | |
| 485, 486 | D-amino acid dehydrogenase small subunit [Herminiimonas arsenicoxydans] D-amino acid dehydrogenase small subunit [Bradyrhizobium japonicum USDA 110] | 273777333 | 1.00E-167 | Bradyrhizobium japonicum USDA 110 | P. aeruginosa virulence gene VIR14, protein. | ADQ03060 | 1.00E-154 | Human ORFX protein sequence SEQ ID NO: 19716. | ABN17150 | 2.00E-11 | 1.4.99.1 | 1269 | 422 | 0 | 421 | 67 | |

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 487, 488 | D-amino-acid dehydrogenase [*Sinorhizobium medicae* WSM419] gi\|113726415\|gb\|EAU07507.1\| D-amino-acid dehydrogenase [*Sinorhizobium medicae* WSM419] | 113871743 | 1.00E-129 | *Sinorhizobium medicae* WSM419 | Glyphosate oxidoreductase gene downstream flanking region. | AAR22262 | 1.00E-35 | M. tuberculosis low oxygen induced antigen Rv0363c SEQ ID NO: 4. | ADI37347 | 3.7 | 1.-.-.- | 1263 | 420

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 495, 496 | D-amino-acid dehydrogenase [*Rhodopseudomonas palustris* BisA53] | 115523700 | 1.00E-112 | *Rhodopseudomonas palustris* BisA53 | Glyphosate oxidoreductase gene downstream flanking region. | AAR22262 | 2.00E-54 | Plan full length insert polynucleotide seqid 4980. | ADO81304 | 0.92 | 1.4.99.1 | 1254 | 417 | 0 | 417 | 49 | |
| 497, 498 | D-amino-acid dehydrogenase [*Sinorhizobium medicae* WSM419] gi\|113726415\|gb\|EAU07507.1\| D-amino-acid dehydrogenase [*Sinorhizobium medicae* WSM419] | 113871743 | 1.00E-129 | *Sinorhizobium medicae* WSM419 | Glyphosate oxidoreductase gene downstream flanking region. | AAR22262 | 1.00E-35 | Drosophila melanogaster polypeptide SEQ ID NO 24465. | ABL27820 | 3.7 | 1... | 1263 | 420 | 0 | 417 | 53 | |
| 499, 500 | D-amino-acid dehydrogenase [*Rhodopseudomonas palustris* BisA53] | 115523700 | 1.00E-112 | *Rhodopseudomonas palustris* BisA53 | Glyphosate oxidoreductase gene downstream flanking region. | AAR22262 | 2.00E-36 | Human reproductive system related antigen DNA SEQ ID NO: 8114. | AAL04340 | 0.91 | 1.4.99.1 | 1245 | 414 | 0 | 417 | 49 | |
| 501, 502 | delta-1-pyrroline-5-carboxylate dehydrogenase [*Corynebacterium jeikeium* K411] | 68535524 | 1.00E-174 | *Corynebacterium jeikeium* K411 | *Corynebacterium glutamicum* MP protein sequence SEQ ID NO: 1148. | AAB79787 | 1.00E-170 | *Corynebacterium glutamicum* MP protein sequence SEQ ID NO: 1148. | AAF71906 | 0.11 | 1.5.1.12 | 2334 | 777 | 0 | 1158 | 48 | |
| 503, 504 | D-amino acid dehydrogenase, small chain [*Blastopirellula marina* DSM 3645] gi\|87287337\|gb\|EAQ79237.1\| D-amino acid dehydrogenase, small chain [*Blastopirellula marina* DSM 3645] | 87309573 | 1.00E-129 | *Blastopirellula marina* DSM 3645 | *C glutamicum* coding sequence fragment SEQ ID NO: 1935. | AAG93079 | 8.00E-44 | Bacterial polypeptide #10001. | ADS59567 | 0.015 | 1.4.99.1 | 1263 | 420 | 0 | 416 | 49 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 505, 506 | D-amino acid dehydrogenase, small chain [Blastopirellula marina DSM 3645] gi\|87287337\|gb\|EAQ79237.1\| D-amino acid dehydrogenase, small chain [Blastopirellula marina DSM 3645] | 87309573 | 1.00E-127 | Blastopirellula marina DSM 3645 | P. aeruginosa virulence gene VIR14, protein. | ADQ03060 | 2.00E-43 | Propionibacterium acnes predicted ORF-encoded polypeptide #300. | ACF64502 | 0.93 | 1.4.99.1 | 1266 | 421 | 0 | 416 | 50 | |
| 507, 508 | D-amino-acid dehydrogenase [Nitrobacter hamburgensis X14] | 92118208 | 1.00E-174 | Nitrobacter hamburgensis X14 | Glyphosate oxidoreductase gene downstream flanking region. | AAR22262 | 6.00E-55 | M. xanthus protein sequence, seq id 9726. | ACL63896 | 0.059 | 1.4.99.1 | 1254 | 417 | 0 | 433 | 71 | |
| 509, 510 | D-amino-acid dehydrogenase [Rhodopseudomonas palustris HaA2] | 86750758 | 1.00E-115 | Rhodopseudomonas palustris HaA2 | Glyphosate oxidoreductase gene downstream flanking region. | AAR22262 | 3.00E-53 | Maize carotenoid cleavage dioxygenase (CCD1) protein SEQ ID NO: 4. | ADP48960 | 3.6 | 1.4.99.1 | 1245 | 414 | 0 | 417 | 49 | |
| 511, 512 | D-amino acid dehydrogenase [Ralstonia eutropha JMP134] | 73541345 | 1.00E-166 | Ralstonia eutropha JMP134 | Glyphosate oxidoreductase gene downstream flanking region. | AAR22262 | 1.00E-42 | Klebsiella pneumoniae polypeptide seqid 7178. | ACH97397 | 0.015 | 1.4.99.1 | 1266 | 421 | 0 | 414 | 65 | |
| 513 | D-amino acid dehydrogenase small subunit [Herminiimonas arsenicoxydans] gi\|133737889\|emb\|CAL60934.1\| D-amino acid dehydrogenase small subunit [Herminiimonas arsenicoxydans] | 134093986 | 0 | Herminiimonas arsenicoxydans | P. aeruginosa virulence gene VIR14, protein. | ADQ03060 | 4.00E-94 | Prokaryotic essential gene #34740. | ACA35076 | 2.00E-04 | 1.4.99.1 | 1269 | 422 | 0 | 443 | 77 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 515, 516 | D-amino acid dehydrogenase; small subunit [*Pseudomonas stutzeri* A1501] | 146284421 | 1.00E-177 | *Pseudomonas stutzeri* A1501 | Acinetobacter baumannii protein #19. | ADA36679 | 1.00E-124 | Alpha1-antitrypsin specific probe, AATpro. | AEF51726 | 0.91 | 1.4.99.1 | 1242 | 413 | 0 | 419 | 74 | |
| 517, 518 | D-amino acid dehydrogenase [*Algoriphagus sp.* PR1] gi|126578095|gb|EA28315.1| D-amino acid dehydrogenase [*Algoriphagus sp.* PR1] | 126646463 | 1.00E-110 | *Algoriphagus sp.* PR1 | Acinetobacter baumannii protein #19. | ADA33588 | 5.00E-46 | Human DICE-1-like RNA helicase. | ACA63029 | 0.058 | 1.4.99.1 | 1239 | 412 | 0 | 415 | 48 | |
| 519, 520 | D-amino acid dehydrogenase [*Flavobacteriales bacterium* HTCC2170] gi|88708933|gb|E AR01167.1| D-amino acid dehydrogenase [*Flavobacteriales bacterium* HTCC2170] | 88712395 | 3.00E-98 | *Flavobacteriales bacterium* HTCC2170 | *N. gonorrhoeae* nucleotide sequence SEQ ID 4691. | ABP80542 | 4.00E-45 | PCR primer used to amplify an ORF of *Chlamydia pneumoniae*. | AAX91990 | 0.015 | 1.4.99.1 | 1251 | 416 | 0 | 416 | 43 | |
| 521, 522 | D-amino-acid dehydrogenase small subunit [*Rhodococcus sp.* RHA1] | 111019145 | 0 | *Rhodococcus sp.* RHA1 | C glutamicum coding sequence fragment SEQ ID NO: 1935. | AAG93079 | 1.00E-102 | Ryegrass caffeic acid O-methyl transferase (OMT) genomic sequence #2. | ABK13581 | 0.015 | 1.4.99.1 | 1254 | 417 | 0 | 415 | 79 | |
| 523, 524 | D-amino acid dehydrogenase [*Algoriphagus sp.* PR1] gi|126578095|gb|EAZ82315.1| D-amino acid dehydrogenase [*Algoriphagus sp.* PR1] | 126646463 | 7.00E-87 | *Algoriphagus sp.* PR1 | H. pylori GHPO 1099 gene. | AAW98270 | 7.00E-48 | Human protein sequence hCP39072. | ACN44966 | 0.23 | 1.4.99.1 | 1245 | 414 | 0 | 415 | 40 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 525, 526 | D-amino-acid dehydrogenase [Ralstonia pickettii 12J] gi\|121302471\|gb\|EAX43440.1\| D-amino-acid dehydrogenase [Ralstonia pickettii 12J] | 121530396 | 1.00E-146 | Ralstonia pickettii 12J | Glyphosate oxidoreductase gene downstream flanking region. | AAR22262 | 2.00E-45 | PCR primer used to amplify bleomycin (BLM) gene cluster ORF15. | AAA58472 | 0.91 | 1.... | 1242 | 413 | 0 | 416 | 61 | |
| 527, 528 | putative d-amino acid dehydrogenase small subunit [Rhizobium leguminosarum bv. viciae 3841] | 116250556 | 0 | Rhizobium leguminosarum bv. viciae 3841 | Glyphosate oxidoreductase gene downstream flanking region. | AAR22262 | 4.00E-47 | Bacterial polypeptide #10001. | ADS59863 | 0.058 | 1.... | 1248 | 415 | 0 | 415 | 78 | |
| 529, 530 | D-amino acid dehydrogenase [Nitrobacter hamburgensis X14] | 92118208 | 1.00E-116 | Nitrobacter hamburgensis X14 | Glyphosate oxidoreductase gene downstream flanking region. | AAR22262 | 7.00E-48 | RT-PCR primer to amplify human tumor associated antigen RNA Seq 28. | ADZ14743 | 0.058 | 1.4.99.1 | 1245 | 414 | 0 | 433 | 53 | |
| 531, 532 | probable D-amino acid dehydrogenase subunit [Limnobacter sp. MED105] | 149824671 | 1.00E-150 | Limnobacter sp. MED105 | P. aeruginosa virulence gene VIR14, protein. | ADQ03060 | 1.00E-93 | Pseudomonas aeruginosa polypeptide #3. | ABD17880 | 0.001 | 1.4.99.1 | 1257 | 418 | 0 | 429 | 59 | |
| 533, 534 | D-amino acid dehydrogenase [Flavobacteriales bacterium HTCC2170] gi\|88708933\|gb\|EAR01167.1\| D-amino acid dehydrogenase [Flavobacteriales bacterium HTCC2170] | 88712395 | 3.00E-88 | Flavobacteriales bacterium HTCC2170 | M. catarrhalis protein #1. | ADL05210 | 5.00E-46 | Prokaryotic essential gene #34740. | ACA35414 | 0.93 | 1.4.99.1 | 1269 | 422 | 0 | 416 | 40 | |
| 535, 536 | Aldehyde dehydrogenase [Ralstonia eutropha JMP134] | 73537548 | 1.00E-143 | Ralstonia eutropha JMP134 | Bacterial polypeptide #10001. | ADN25785 | 1.00E-140 | Bacterial polypeptide #10001. | ADS55665 | 1.00E-12 | 1.2.1. | 1581 | 526 | 0 | 525 | 52 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 537, 538 | D-amino-acid dehydrogenase [Ralstonia eutropha JMP134] | 73541345 | 1.00E-136 | Ralstonia eutropha JMP134 | Glyphosate oxidoreductase gene downstream flanking region. | AAR22262 | 1.00E-47 | Streptomyces sp. cytochrome P450 related PCR primer SEQ ID NO: 18. | ABN88913 | 3.6 | 1.4.99.1 | 1260 | 419 | 0 | 414 | 57 | |
| 539, 540 | D-amino acid dehydrogenase [Burkholderia cepacia AMMD] | 115359189 | 0 | Burkholderia cepacia AMMD | Glyphosate oxidoreductase gene downstream flanking region. | AAR22262 | 3.00E-47 | Pseudomonas aeruginosa polypeptide #3. | ABD17784 | 0.058 | 1.4.99.1 | 1242 | 413 | 0 | 413 | 96 | |
| 541, 542 | D-amino acid dehydrogenase subunit [Xanthomonas axonopodis pv. citri str. 306]. | 21243478 | 1.00E-139 | Xanthomonas axonopodis pv. citri str. 306 | P. aeruginosa virulence gene VIR14, protein. | ADQ03060 | 3.00E-40 | M. capsulatus gene #766 for DNA array. | ABQ90794 | 0.059 | 1.4.99.1 | 1266 | 421 | 1251 | 416 | 57 | |
| 543, 544 | D-amino acid dehydrogenase small subunit, putative [Microscilla marina ATCC 23134 gi|123984082|gb|EAY24455.1| D-amino acid dehydrogenase small subunit, putative [Microscilla marina ATCC 23134] | 124009931 | 1.00E-107 | Microscilla marina ATCC 23134 | H. pylori GHPO 1099 gene. | AAW98270 | 3.00E-50 | lactic acid bacteria lactobacillus johnsonii La1 genomic DNA SEQ ID NO: 1. | ADF77343 | 3.6 | 1.4.99.1 | 1248 | 415 | 0 | 427 | 45 | |
| 545, 546 | D-amino-acid dehydrogenase [Rhodopseudomonas palustris HaA2] | 86750758 | 1.00E-117 | Rhodopseudomonas palustris HaA2 | Glyphosate oxidoreductase gene downstream flanking region. | AAR22262 | 7.00E-51 | Arabidopsis thaliana protein fragment SEQ ID NO: 76191. | AAC41739 | 0.24 | 1.4.99.1 | 1296 | 431 | 0 | 417 | 50 | |
| 547, 548 | D-amino acid dehydrogenase [Flavobacteriales bacterium HTCC2170 gi|88708933|gb|EAR01167.1] | 88712395 | 3.00E-86 | Flavobacteriales bacterium HTCC2170 | Photorhabdus luminescens protein sequence #59. | ABM69115 | 5.00E-53 | Bacterial polypeptide #10001. | ADS50144 | 0.93 | 1.4.99.1 | 1266 | 421 | 0 | 416 | 39 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | D-amino acid dehydrogenase [Flavobacteriales bacterium HTCC2170] | | | | | | | | | | | | | | | | |
| 549, 550 | probable D-aminoacid dehydrogenase subunit [Limnobacter sp. MED105] | 149824671 | 1.00E-146 | Limnobacter sp. MED105 | P. aeruginosa virulence gene VIR14, protein. | ADQ03060 | 9.00E-96 | Human breast cancer expressed polynucleotide 8440. | AAL13181 | 2.00E-04 | 1.4.99.1 | 1254 | 417 | 0 | 429 | 59 | |
| 551, 552 | delta-1-pyrroline-5-carboxylate dehydrogenase [Corynebacterium jeikeium K411] | 68535524 | 0 | Corynebacterium jeikeium K411 | Corynebacterium glutamicum MP protein sequence SEQ ID NO: 1148. | AAB79787 | 0 | Propionibacterium acnes predicted ORF-encoded polypeptide #300. | ACF64460 | 0.003 | 1.5.1.12 | 3306 | 1101 | 0 | 1158 | 49 | |
| 553, 554 | D-amino-acid dehydrogenase [Rhodopseudomonas palustris BisA53] | 115523700 | 1.00E-112 | Rhodopseudomonas palustris BisA53 | Glyphosate oxidoreductase gene downstream flanking region. | AAR22262 | 1.00E-53 | Plan full length insert polynucleotide seqid 4980. | ADO81304 | 0.92 | 1.4.99.1 | 1254 | 417 | 0 | 417 | 49 | |
| 555, 556 | D-amino-acid dehydrogenase [Nitrobacter hamburgensis X14] | 92118208 | 1.00E-118 | Nitrobacter hamburgensis X14 | Glyphosate oxidoreductase gene downstream flanking region. | AAR22262 | 2.00E-49 | RT-PCR primer to amplify human tumor associated antigen RNA Seq 28. | ADZ14743 | 0.058 | 1.4.99.1 | 1242 | 413 | 0 | 433 | 53 | |
| 557, 558 | D-amino-acid dehydrogenase [Sinorhizobium medicae WSM419] gi|113726415|gb|EAU07507.1| D-amino-acid dehydrogenase [Sinorhizobium medicae WSM419] | 113871743 | 1.00E-132 | Sinorhizobium medicae WSM419 | Glyphosate oxidoreductase gene downstream flanking region. | AAR22262 | 5.00E-41 | Human protein sequence hCP39072. | ACN44650 | 0.23 | 1.... | 1260 | 419 | 0 | 417 | 55 | |

APPENDIX 1-continued

| SEQ ID NO: | NR Description | NR Accession Code | NR Evalue | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|
| 559, 560 | D-amino-acid dehydrogenase [Sinorhizobium medicae WSM419] gi\|113726415\|gb\|EAU07507.1\| D-amino-acid dehydrogenase [Sinorhizobium medicae WSM419] NADH | 113871743 | 1.00E-132 | Glyphosate oxidoreductase gene downstream flanking region. | AAR22262 | 5.00E-41 | Human protein sequence hCP39072. | ACN44650 | 0.23 | 1... | 1260 | 419 | 0 | 417 | 55 | |
| 561, 562 | dehydrogenase [Xanthomonas axonopodis pv. citri str. 306]. | 21244546 | 1.00E-143 | M. xanthus protein sequence, seq id 9726. | ABM91806 | 1.00E-115 | M. xanthus protein sequence, seq id 9726. | ACL64800 | 2.00E-05 | 1.6.99.3 | 1230 | 409 | 1293 | 430 | 62 | 69 |
| 563, 564 | short chain dehydrogenase [Ralstonia eutropha JMP134] | 73541108 | 3.00E-66 | M. xanthus protein sequence, seq id 9726. | ABM96904 | 1.00E-53 | Cenarchaeum symbiosum open reading frame protein sequence SEQ ID NO: 80. | AAA55186 | 5.00E-04 | 1.1.1.100 | 720 | 239 | 0 | 270 | 56 | |
| 565, 566 | D-amino-acid dehydrogenase [Rhodopseudomonas palustris BisA53] | 115523700 | 1.00E-112 | Glyphosate oxidoreductase gene downstream flanking region. | AAR22262 | 2.00E-54 | Plan full length insert polynucleotide seqid 4980. | ADO81304 | 0.92 | 1.4.99.1 | 1254 | 417 | 0 | 417 | 49 | |
| 567, 568 | D-amino-acid dehydrogenase [Acidovorax avenae subsp. citrulli AAC00-1] gi\|120587303\|gb\|ABM30743.1\| D-amino-acid dehydrogenase [Acidovorax avenae subsp. citrulli AAC00-1] | 120608839 | 0 | P. aeruginosa virulence gene VIR14, protein. | ADQ03060 | 2.00E-91 | Klebsiella pneumoniae polypeptide seqid 7178. | ACH97385 | 0.016 | 1.4.99.1 | 1344 | 447 | 0 | 444 | 69 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 569, 570 | D-amino-acid dehydrogenase [*Maricaulis maris* MCS10] gi\|114341114\|gb\|ABI66394.1\| D-amino-acid dehydrogenase [*Maricaulis maris* MCS10] | 114570652 | 8.00E-91 | *Maricaulis maris* MCS10 | P. aeruginosa virulence gene VIR14, protein. | ADQ03060 | 9.00E-80 | Lung specific protein (LSP) #21. | ABX92073 | 0.92 | 1.4.99.1 | 1260 | 419 | 0 | 427 | 42 | 74 |
| 571, 572 | AGR_L_3050p [*Agrobacterium tumefaciens*]. | 15891640 | 1.00E-180 | *Agrobacterium tumefaciens* | P. aeruginosa virulence gene VIR14, protein. | ADQ03060 | 1.00E-141 | *Klebsiella pneumoniae* polypeptide seqid 7178. | ABD01189 | 3.00E-13 | 1.4.99.1 | 1248 | 415 | 1257 | 418 | 76 | |
| 573, 574 | D-amino acid dehydrogenase [*Robiginitalea biformata* HTCC2501] gi\|88783849\|gb\|EAR15020.1\| D-amino acid dehydrogenase [*Robiginitalea biformata* HTCC2501] | 88806240 | 5.00E-85 | *Robiginitalea biformata* HTCC2501 | Enterobacter cloacae protein amino acid sequence - SEQ ID 5666. | AEH60497 | 2.00E-47 | Prokaryotic essential gene #34740. | ACA26568 | 0.059 | 1.4.99.1 | 1263 | 420 | 0 | 417 | 39 | |
| 575, 576 | Aldehyde dehydrogenase [*Ralstonia eutropha* JMP134] | 72384235 | 1.00E-141 | *Ralstonia eutropha* JMP134 | Bacterial polypeptide #10001. | ADN22241 | 1.00E-133 | Bacterial polypeptide #10001. | ADS56451 | 2.00E-08 | 1.2.1 | 1584 | 527 | 0 | 530 | 53 | |
| 577, 578 | putative d-amino acid dehydrogenase small subunit [*Rhizobium leguminosarum* bv. viciae 3841] | 116250556 | 1.00E-166 | *Rhizobium leguminosarum* bv. viciae 3841 | Glyphosate oxidoreductase gene downstream flanking region. | AAR22262 | 8.00E-44 | *M. xanthus* protein sequence, seq id 9726. | ACL64632 | 0.91 | 1... | 1242 | 413 | 0 | 415 | 67 | |
| 579, 580 | D-amino-acid dehydrogenase; small subunit protein [*Rhizobium etli* CFN 42] | 86361166 | 0 | *Rhizobium etli* CFN 42 | P. aeruginosa virulence gene VIR14, protein. | ADQ03060 | 1.00E-143 | *Rhizobium* species symbiotic plasmid pNGR234. | AAV30459 | 7.00E-51 | 1.4.99.1 | 1254 | 417 | 0 | 422 | 83 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 581, 582 | D-amino-acid dehydrogenase [Ralstonia autropha JMP134] | 73541345 | 1.00E-136 | Ralstonia autropha JMP134 | Glyphosate oxidoreductase gene downstream flanking region. | AAR22262 | 4.00E-47 | Thalecress stress related protein SEQ ID NO: 80. | AEG64174 | 0.92 | 1.4.99.1 | 1260 | 419 | 0 | 414 | 57 | |
| 583, 584 | D-amino-acid dehydrogenase [Burkholderia xenovorans LB400] | 91779297 | 0 | Burkholderia xenovorans LB400 | Glyphosate oxidoreductase gene downstream flanking region. | AAR22262 | 9.00E-48 | Pseudomonas aeruginosa polypeptide #3. | ABD13052 | 3.6 | 1.4.99.1 | 1233 | 410 | 0 | 410 | 83 | |
| 585, 586 | D-amino-acid dehydrogenase [Polaromonas naphthalenivorans CJ2] | 121603011 | 0 | Polaromonas naphthalenivorans CJ2 | Photorhabdus luminescens protein sequence #59 | ABM69115 | 3.00E-85 | Klebsiella pneumoniae polypeptide seqid 7178. | ABD01189 | 3.00E-04 | 1.4.99.1 | 1338 | 445 | 0 | 455 | 81 | |
| 587, 588 | D-amino acid dehydrogenase; small subunit family protein [Pseudomonas entomophila L48] | 104781752 | 1.00E-139 | Pseudomonas entomophila L48 | Glyphosate oxidoreductase gene downstream flanking region. | AAR22262 | 3.00E-50 | Drosophila melanogaster polypeptide SEQ ID NO 24465. | ABL10910 | 0.24 | 1.4.99.1 | 1290 | 429 | 0 | 414 | 57 | |
| 589, 590 | D-amino-acid dehydrogenase small subunit [Rhodococcus sp. RHA1] | 111019145 | 1.00E-166 | Rhodococcus sp. RHA1 | C glutamicum coding sequence fragment SEQ ID NO: 1935. | AAG93079 | 1.00E-103 | M. xanthus protein sequence, seq id 9726. | ACL64760 | 0.92 | 1.4.99.1 | 1254 | 417 | 0 | 415 | 78 | |
| 591, 592 | D-amino-acid dehydrogenase [Sinorhizobium medicae WSM419] gi|113726415|gb|EAU07507.1| D-amino-acid dehydrogenase [Sinorhizobium medicae WSM419] | 113871743 | 1.00E-145 | Sinorhizobium medicae WSM419 | Glyphosate oxidoreductase gene downstream flanking region. | AAR22262 | 9.00E-50 | Plan full length insert polynucleotide seqid 4980. | ADX35599 | 0.015 | 1... | 1245 | 414 | 0 | 417 | 59 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 593, 594 | D-amino-acid dehydrogenase [Rhodopseudomonas palustris HaA2] | 86750758 | 1.00E−118 | Rhodopseudomonas palustris HaA2 | Glyphosate oxidoreductase gene downstream flanking region. | AAR22262 | 4.00E−56 | Prokaryotic essential gene #34740. | ACA26173 | 0.015 | 1.4.99.1 | 1272 | 423 | 0 | 417 | 50 | |
| 595, 596 | D-amino-acid dehydrogenase [Nitrobacter hamburgensis X14] | 92118208 | 0 | Nitrobacter hamburgensis X14 | Glyphosate oxidoreductase gene downstream flanking region. | AAR22262 | 5.00E−56 | Bacterial polypeptide #10001. | ADS55748 | 0.015 | 1.4.99.1 | 1257 | 418 | 0 | 433 | 73 | |
| 597, 598 | D-amino-acid dehydrogenase small subunit protein [Chromobacterium violaceum ATCC 12472] | 34497369 | 0 | Chromobacterium violaceum ATCC 12472 | P. aeruginosa virulence gene VIR14, protein. | ADQ03060 | 1.00E−166 | Enterobacter cloacae protein amino acid sequence - SEQ ID 5666. | AEH53102 | 3.00E−19 | 1.4.99.1 | 1317 | 438 | 0 | 435 | 71 | |
| 599, 600 | D-amino-acid dehydrogenase; small subunit protein [Rhizobium etli CFN 42] | 86361166 | 0 | Rhizobium etli CFN 42 | P. aeruginosa virulence gene VIR14, protein. | ADQ03060 | 1.00E−145 | Rhizobium species symbiotic plasmid pNGR234. | AAV30459 | 1.00E−61 | 1.4.99.1 | 1251 | 416 | 0 | 422 | 84 | |
| 601, 602 | D-amino acid dehydrogenase; small subunit protein [Rhizobium etli CFN 42] | 86361166 | 0 | Rhizobium etli CFN 42 | P. aeruginosa virulence gene VIR14, protein. | ADQ03060 | 1.00E−145 | Rhizobium species symbiotic plasmid pNGR234. | AAV30459 | 2.00E−60 | 1.4.99.1 | 1254 | 417 | 0 | 422 | 81 | |
| 603, 604 | D-amino acid dehydrogenase [Flavobacteriales bacterium HTCC2170] gi|88708933|gb|EAR01167.1| D-amino acid dehydrogenase [Flavobacteriales bacterium HTCC2170] | 88712395 | 2.00E−93 | Flavobacteriales bacterium HTCC2170 | M. catarrhalis protein #1. | ADL05210 | 2.00E−54 | Corn ear-derived polynucleotide (cpd) #5394. | ABX86147 | 0.23 | 1.4.99.1 | 1254 | 417 | 0 | 416 | 42 | |

APPENDIX 1-continued

| SEQ ID NO: | NR Description | NR Accession Code | NR Evalue | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|
| 605, 606 | D-amino-acid dehydrogenase [Sinorhizobium medicae WSM419] gi\|113726415\|gb\|EAU07507.1\| D-amino-acid dehydrogenase [Sinorhizobium medicae WSM419] | 113871743 | 1.00E-170 | Glyphosate oxidoreductase gene downstream flanking region. | AAR22262 | 2.00E-48 | Bacterial polypeptide #10001. | ADS56578 | 0.92 | 1.... | 1254 | 417 | 0 | 417 | 67 | |
| 607, 608 | probable D-amino acid dehydrogenase subunit [Limnobacter sp. MED105] | 149824671 | 1.00E-125 | P. aeruginosa virulence gene VIR14, protein. | ADQ03060 | 1.00E-94 | Insulin signaling pathway related PCR primer, SEQ ID 22. | ADZ49334 | 0.91 | 1.4.99.1 | 1251 | 416 | 0 | 429 | 51 | |
| 609, 610 | D-amino-acid dehydrogenase [Ralstonia pickettii 12J] gi\|121302471\|gb\|EAX43440.1\| D-amino-acid dehydrogenase [Ralstonia pickettii 12J] | 121530396 | 1.00E-146 | Glyphosate oxidoreductase gene downstream flanking region. | AAR22262 | 1.00E-45 | Plant polypeptide, SEQ ID 5546. | ADT18820 | 0.004 | 1.... | 1233 | 410 | 0 | 416 | 61 | |
| 611, 612 | D-amino-acid dehydrogenase; small subunit protein [Rhizobium etli CFN 42] | 86361166 | 0 | P. aeruginosa virulence gene VIR14, protein. | ADQ03060 | 1.00E-143 | Rhizobium species symbiotic plasmid pNGR234. | AAV30459 | 7.00E-51 | 1.4.99.1 | 1254 | 417 | 0 | 422 | 83 | |
| 613, 614 | D-amino acid dehydrogenase small subunit [Marinobacter algicola DG893] | 149377918 | 3.00E-98 | N. gonorrhoeae nucleotide sequence SEQ ID 4691. | ABP80542 | 3.00E-77 | Arabidopsis thaliana protein fragment SEQ ID NO: 76191. | ABQ66079 | 0.24 | 1.4.99.1 | 1287 | 428 | 0 | 423 | 43 | |
| 615, 616 | putative d-amino acid dehydrogenase small subunit [Rhizobium leguminosarum bv. viciae 3841] | 116250556 | 0 | Glyphosate oxidoreductase gene downstream flanking region. | AAR22262 | 3.00E-47 | M. xanthus protein sequence, seq id 9726. | ACL64301 | 0.91 | 1.... | 1248 | 415 | 0 | 415 | 79 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 617, 618 | D-amino-acid dehydrogenase [Rhodopseudomonas palustris HaA2] | 86750758 | 1.00E-113 | Rhodopseudomonas palustris HaA2 | Glyphosate oxidoreductase gene downstream flanking region. | AAR22262 | 1.00E-49 | Plan full length insert polynucleotide seqid 4980. | ADX64511 | 0.015 | 1.4.99.1 | 1245 | 414 | 0 | 417 | 49 | |
| 619, 620 | aldehyde dehydrogenase [Burkholderia phymatum STM815] gi|117986837|gb|EAV01212.1| aldehyde dehydrogenase [Burkholderia phymatum STM815] | 118027543 | 1.00E-144 | Burkholderia phymatum STM815 | Bacterial polypeptide #10001. | ADN25785 | 1.00E-131 | Bacterial polypeptide #10001. | ADS55665 | 1.00E-12 | 1.2.1.39 | 1593 | 530 | 0 | 526 | 51 | |
| 621, 622 | D-amino acid dehydrogenase [Flavobacteriales bacterium HTCC2170] gi|88708933|gb|EAR01167.1| D-amino acid dehydrogenase [Flavobacteriales bacterium HTCC2170] | 88712395 | 1.00E-92 | Flavobacteriales bacterium HTCC2170 | Pseudomonas aeruginosa polypeptide #3. | ABO75104 | 1.00E-48 | Bifidobacterium longum NCC2705 ORF amino acid sequence SEQ ID NO: 408. | ABQ81842 | 0.059 | 1.4.99.1 | 1266 | 421 | 0 | 416 | 42 | |
| 623, 624 | D-amino acid dehydrogenase small subunit [Rhodobacter sphaeroides 2.4.1] | 77465126 | 1.00E-121 | Rhodobacter sphaeroides 2.4.1 | Photorhabdus luminescens protein sequence #59 | ABM69115 | 1.00E-111 | Pseudomonas aeruginosa polypeptide #3. | ABD08815 | 3.00E-07 | 1.4.99.1 | 1260 | 419 | 0 | 436 | 55 | |
| 625, 626 | D-amino-acid dehydrogenase [Sphingomonas wittichii RW1] | 148553731 | 0 | Sphingomonas wittichii RW1 | P. aeruginosa virulence gene VIR14, protein. | ADQ03060 | 1.00E-143 | P. aeruginosa virulence gene VIR14, protein. | ADQ03059 | 4.00E-09 | 1.4.99.1 | 1254 | 417 | 0 | 416 | 79 | |
| 627, 628 | probable D-amino acid dehydrogenase subunit [Limnobacter sp. MED105] | 149824671 | 1.00E-151 | Limnobacter sp. MED105 | P. aeruginosa virulence gene VIR14, protein. | ADQ03060 | 2.00E-93 | P. aeruginosa virulence gene VIR14, protein. | ADQ03059 | 0.059 | 1257 | 418 | 0 | 429 | 60 | | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 629, 630 | putative dehydrogenase [Streptomyces parvulus] | 39725441 | 5.00E-63 | Streptomyces parvulus | Streptomyces parvulus borrelidin polyketide synthase orfB8 protein. | ADQ74690 | 1.00E-63 | Streptomyces parvulus borrelidin polyketide synthase orfB8 protein. | ADQ74672 | 0.17 | 1... | 921 | 306 | 74787 | 305 | | |
| 631, 632 | FAD dependent oxidoreductase [Burkholderia phytofirmans PsJN] gi\|117992233\|gb\|EAV06525.1\| FAD dependent oxidoreductase [Burkholderia phytofirmans PsJN] | 118037424 | 0 | Burkholderia phytofirmans PsJN | Glyphosate oxidoreductase gene downstream flanking region. | AAR22262 | 3.00E-49 | Rice abiotic stress responsive polypeptide SEQ ID NO: 4152. | ACL30152 | 0.015 | 1.4.99.1 | 1233 | 410 | 0 | 465 | 86 | |
| 633, 634 | FAD dependent oxidoreductase [Delftia acidovorans SPH-1] gi\|118665742\|gb\|EAV72348.1\| FAD dependent oxidoreductase [Delftia acidovorans SPH-1] | 118734342 | 0 | Delftia acidovorans SPH-1 | Acinetobacter baumannii protein #19. | ADA33588 | 1.00E-174 | Pseudomonas aeruginosa polypeptide #3. | ABD08815 | 8.00E-23 | 1.4.99.1 | 1293 | 430 | 0 | 432 | 74 | |
| 635, 636 | FAD dependent oxidoreductase [Delftia acidovorans SPH-1] gi\|118665742\|gb\|EAV72348.1\| FAD dependent oxidoreductase [Delftia acidovorans SPH-1] | 118734342 | 0 | Delftia acidovorans SPH-1 | Acinetobacter baumannii protein #19. | ADA33588 | 1.00E-175 | Pseudomonas aeruginosa polypeptide #3. | ABD08815 | 2.00E-32 | 1.4.99.1 | 1296 | 431 | 0 | 432 | 76 | |
| 637, 638 | FAD dependent oxidoreductase [Pseudomonas | 77457196 | 0 | Pseudomonas fluorescens PfO-1 | Pseudomonas aeruginosa polypeptide #3. | ABO71517 | 1.00E-151 | Pseudomonas aeruginosa polypeptide #3. | ABD05088 | 2.00E-66 | 1.1.99. | 1128 | 375 | 0 | 375 | 87 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 639, 640 | fluorescens PfO-1] oxidoreductase-like [Roseiflexus castenholzii DSM 13941] gi|118014488|gb|EAV28464.1| oxidoreductase-like [Roseiflexus castenholzii DSM 13941] | 118061388 | 4.00E−72 | Roseiflexus castenholzii DSM 13941 | Hyper-thermophile Methano-pyrus kandleri protein #28. | ADM25642 | 2.00E−38 | Prokaryotic essential gene #34740. | ACA27410 | 0.18 | 1.1.1. | 1002 | 333 | 0 | 345 | 44 | |
| 641, 642 | FAD dependent oxidoreductase [Pseudomonas fluorescens PfO-1] | 77457196 | 0 | Pseudomonas fluorescens PfO-1 | Pseudomonas aeruginosa polypeptide #3. | ABO71517 | 1.00E−151 | Pseudomonas aeruginosa polypeptide #3. | ADB05088 | 2.00E−66 | 1.1.99.1 | 1128 | 375 | 0 | 375 | 87 | |
| 643, 644 | Glycine/D-amino acid oxidase [Magneto-spirillum magneticum AMB-1] | 83311898 | 4.00E−86 | Magneto-spirillum magneticum AMB-1 | Pseudomonas aeruginosa polypeptide #3. | ABO75104 | 8.00E−78 | Human ORFX protein sequence SEQ ID NO: 19716. | ABN17150 | 0.059 | 1.4.99.1 | 1266 | 421 | 0 | 422 | 42 | |
| 645, 646 | FAD dependent oxidoreductase [Chromo-halobacter salexigens DSM 3043] | 92113847 | 1.00E−151 | Chromo-halobacter salexigens DSM 3043 | Glyphosate oxidoreductase gene downstream flanking region. | AAR22262 | 2.0E−40 | Silibacter sp. TM1040 gene SEQ ID NO: 3. | AEM45684 | 0.23 | 1... | 1245 | 414 | 0 | 414 | 62 | |
| 647, 648 | FAD dependent oxidoreductase [Burkholderia phymatum STM815] gi|117985258|gb|EAU99635.1| FAD dependent oxidoreductase [Burkholderia phymatum STM815] | 118029195 | 1.00E−165 | Burkholderia phymatum STM815 | Enterobacter cloacae protein amino acid sequence - SEQ ID 5666. | AEH60497 | 1.00E−150 | Pseudomonas aeruginosa polypeptide #3. | ABD08815 | 2.00E−06 | 1.4.99.1 | 1296 | 431 | 0 | 428 | 65 | |

APPENDIX 1-continued

| SEQ ID NO. | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 649, 650 | FAD dependent oxidoreductase [Chromo-halobacter salexigens DSM 3043] | 92113847 | 1.00E-146 | Chromo-halobacter salexigens DSM 3043 | Glyphosate oxidoreductase gene downstream flanking region. | AAR22262 | 4.00E-43 | Pseudomonas aeruginosa polypeptide #3. | ABD05284 | 0.058 | 1.4.99.1 | 1245 | 414 | 0 | 414 | 61 | |
| 651, 652 | putative oxidoreductase protein [Bradyrhizobium japonicum USDA 110] | 27379412 | 1.00E-122 | Bradyrhizo-bium japonicum USDA 110 | Glyphosate oxidoreductase gene downstream flanking region. | AAR22262 | 1.00E-42 | Prokaryotic essential gene #34740. | ACA27392 | 0.058 | 1.4.99.1 | 1236 | 411 | 0 | 410 | 53 | |
| 653, 654 | reductase [Xanthomonas campestris pv. campestris str. 8004] | 66767863 | 1.00E-128 | Xanthomonas campestris pv. campestris str. 8004 | Prokaryotic essential gene #34740. | ABU14721 | 1.00E-119 | Prokaryotic essential gene #34740. | ACA36215 | 1.00E-15 | 1.8.1.7 | 1344 | 447 | 0 | 456 | 55 | |
| 655, 656 | FAD dependent oxidoreductase [Nitrobacter winogradskyi Nb-255] | 75676467 | 1.00E-118 | Nitrobacter winogradskyi Nb-255 | Glyphosate oxidoreductase gene downstream flanking region. | AAR22262 | 5.00E-53 | G sorghi nitrilase protein fragment #2. | ACF04822 | 0.94 | 1.4.99.1 | 1284 | 427 | 0 | 417 | 48 | |
| 657, 658 | D-aspartate oxidase [Stigmatella aurantiaca DW4/3-1] gi|115366155|gb| EAU65167.1| D-aspartate oxidase [Stigmatella aurantiaca DW4/3-1] | 115376852 | 3.0E-85 | Stigmatella aurantiaca DW4/3-1 | Human D-aspartate oxidase active site. | AED18771 | 6.00E-59 | M. carbonacea polyketide synthase (PKS) domain peptide #3. | AAD55815 | 2.9 | 1.4.3.3 | 1008 | 335 | 0 | 314 | 45 | |
| 659, 660 | FAD dependent oxidoreductase [Dechloromonas aromatica RCB] | 71909453 | 1.00E-142 | Dechloro-monas aromatica RCB | P. aeruginosa virulence gene VIR14, protein. | ADQ03060 | 6.00E-97 | Human brest cancer expressed polynucleotide 8440. | AAL13181 | 0.001 | 1.4.99.1 | 1245 | 414 | 0 | 418 | 62 | |
| 661, 662 | putative secreted protein [Xanthomonas campestris pv. vesicatoria str. 85-10] | 78049397 | 1.00E-102 | Xanthomonas campestris pv. vesicatoria str. 85-10 | Human D-aspartate oxidase active site. | AED18771 | 4.00E-07 | Plant cDNA #31. | ADJ40271 | 0.056 | | 1188 | 395 | 0 | 404 | 50 | |

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 663, 664 | FAD dependent oxidoreductase [*Nitrobacter winogradskyi* Nb-255] | 75676467 | 1.00E-120 | *Nitrobacter winogradskyi* Nb-255 | Glyphosate oxidoreductase gene downstream flanking region. | AAR22262 | 6.00E-52 | Plant full length insert polynucleotide seqid 4980. | ADX45957 | 0.058 | 1.4.99.1 | 1245 | 414 | 0 | 417 | 52 | |
| 665, 666 | Glycine/D-amino acid oxidase [*Nitrococcus mobilis* Nb-231] gi|88791478|gb|EAR22589.1| Glycine/D-amino acid oxidase [*Nitrococcus mobilis* Nb-231] | 88810939 | 5.00E-83 | *Nitrococcus mobilis* Nb-231 | M. catarrhalis protein #1. | ADL05210 | 6.00E-71 | Aspergillus fumigatus essential gene protein #821. | ABT17713 | 0.92 | 1.4.99.1 | 1263 | 420 | 0 | 423 | 41 | |
| 667, 668 | FAD dependent oxidoreductase [*Solibacter usitatus* Ellin6076] gi|116227684|gb|ABJ86393.1| FAD dependent oxidoreductase [*Solibacter usitatus* Ellin6076] | 116624522 | 5.00E-82 | *Solibacter usitatus* Ellin6076 | Human D-aspartate oxidase active site. | AED18771 | 5.00E-17 | DNA encoding nove human diagnostic protein #20574. | AAS83512 | 0.81 | 1.4.3.1 | 1113 | 370 | 0 | 377 | 45 | |
| 669, 670 | FAD dependent oxidoreductase [*Nitrobacter winogradskyi* Nb-255] | 75676467 | 1.00E-122 | *Nitrobacter winogradskyi* Nb-255 | Glyphosate oxidoreductase gene downstream flanking region. | AAR22262 | 2.00E-46 | A. mediterranei-rifamycin synthesis gene cluster fragment protein F. | AAV21187 | 0.92 | 1.4.99.1 | 1260 | 419 | 0 | 417 | 52 | |
| 671, 672 | FAD dependent oxidoreductase [*Burkholderia phytofirmans* PsJN] gi|117991720|gb|EAV06013.1| FAD dependent oxidoreductase [*Burkholderia phytofirmans* PsJN] | 118038076 | 0 | *Burkholderia phytofirmans* PsJN | Glyphosate oxidoreductase gene downstream flanking region. | AAR22262 | 6.00E-46 | Oligo-nucleotide for detecting cytosine methylation SEQ ID NO 20311. | ABQ19293 | 3.6 | 1.4.99.1 | 1242 | 413 | 0 | 413 | 82 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 673, 674 | FAD dependent oxidoreductase [Burkholderia phytofirmans PsJN] gi\|117991720\|gb\|EAV06013.1\| FAD dependent oxidoreductase [Burkholderia phytofirmans PsJN] | 118038076 | 0 | Burkholderia phytofirmans PsJN | Glyphosate oxidoreductase gene downstream flanking region. | AAR22262 | 1.00E-45 | Oligonucleotide for detecting cytosine methylation SEQ ID NO 20311. | ABQ19293 | 3.6 | 1.4.99.1 | 1242 | 413 | 0 | 413 | 82 | |
| 675, 676 | FAD dependent oxidoreductase [Burkholderia phytofirmans PsJN] gi\|117991720\|gb\|EAV06013.1\| FAD dependent oxidoreductase [Burkholderia phytofirmans PsJN] | 118038076 | 0 | Burkholderia phytofirmans PsJN | Glyphosate oxidoreductase gene downstream flanking region. | AAR22262 | 1.00E-45 | Oligonucleotide for detecting cytosine methylation SEQ ID NO 20311. | ABQ19293 | 3.6 | 1.4.99.1 | 1242 | 413 | 0 | 413 | 82 | |
| 677, 678 | D-amino-acid oxidase [Nocardioides sp. JS614] gi\|119536676\|gb\|ABL81293.1\| D-amino-acid oxidase [Nocardioides sp. JS614] | 119716015 | 2.00E-51 | Nocardioides sp. JS614 | Human D-aspartate oxidase active site. | AED18771 | 4.00E-36 | Prokaryotic essential gene #34740. | ACA45556 | 3.6 | 1.4.3.3 | 909 | 302 | 0 | 310 | 42 | |
| 679, 680 | FAD dependent oxidoreductase [Delftia acidovorans SPH-1] gi\|118668198\|gb\|EAV74793.1\| FAD dependent oxidoreductase [Delftia acidovorans SPH-1] | 118731339 | 0 | Delftia acidovorans SPH-1 | Pseudomonas aeruginosa polypeptide #3. | ABO71517 | 1.00E-102 | Pseudomonas aeruginosa polypeptide #3. | ABD04986 | 4.00E-09 | 1.1.99. | 1161 | 386 | 0 | 385 | 83 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 681, 682 | Glycine/D-amino acid oxidase [Nitrococcus mobilis Nb-231] gi|88791478|gb|EAR22589.1| Glycine/D-amin acid oxidase [Nitrococcus mobilis Nb-231] | 88810939 | 5.00E-94 | Nitrococcus mobilis Nb-231 | Pseudomonas aeruginosa polypeptide #3. | ADQ03060 | 5.00E-85 | N benthamiana phytopathogen resistance-related contig cDNA - SEQ ID 5. | ADC76718 | 0.93 | 1.4.99.1 | 1266 | 421 | 0 | 423 | 43 | |
| 683, 684 | FAD dependent oxidoreductase [Alkalilimnicola ehrlichei MLHE-1] | 114319576 | 2.00E-86 | Alkalilimni-cola ehrlichei MLHE-1 | Pseudomonas aeruginosa polypeptide #3. | ABO75104 | 2.00E-77 | C. glutamicum SRT protein sequence SEQ ID NO: 264. | AAF71130 | 0.059 | 1.4.99.1 | 1251 | 416 | 0 | 421 | 42 | |
| 685, 686 | FAD dependent oxidoreductase [Alkalilimnicola ehrlichei MLHE-1] | 114319576 | 5.00E-86 | Alkalilimni-cola ehrlichei MLHE-1 | M. catarrhalis protein #1. | ADL05210 | 3.00E-63 | Human breast cancer associated coding sequence SEQ ID NO: 79. | ABT07579 | 0.06 | 1.4.99.1 | 1281 | 426 | 0 | 421 | 40 | |
| 687, 688 | D-aspartate oxidase [Stigmatella aurantiaca DW4/3-1] gi|115366155|gb|EAU65167.1| D-aspartate oxidase [Stigmatella aurantiaca DW4/3-1] | 115376852 | 2.00E-71 | Stigmatella aurantiaca DW4/3-1 | Human D-aspartate oxidase active site. | AED18771 | 2.00E-51 | Bacterial polypeptide #10001. | ADS56436 | 0.044 | 1.4.3.3 | 957 | 318 | 0 | 314 | 44 | |
| 699, 690 | FAD dependent oxidoreductase [Burkholderia multivorans ATCC 17616] gi|118660081|gb|EAV66824.1| FAD dependent oxidoreductase [Burkholderia multivorans ATCC 17616] | 118716641 | 1.00E-154 | Burkholderia multivorans ATCC 17616 | Glyphosate oxidoreductase gene downstream flanking region. | AAR22262 | 5.00E-53 | Plant full length insert poly-nucleotide seqid 4980. | ADX50476 | 0.23 | 1.4.99.1 | 1248 | 415 | 0 | 548 | 64 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 691, 692 | FAD dependent oxidoreductase [Ralstonia metallidurans CH34] | 94314499 | 1.00E-159 | Ralstonia metallidurans CH34 | Acinetobacter baumannii protein #19. | ADA36679 | 1.00E-128 | N. meningitides partial DNA sequence gnm_640 SEQ ID NO: 640. | AAA81470 | 0.058 | 1.4.99.1 | 1239 | 412 | 0 | 422 | 66 | |
| 693, 694 | NADH: ubiquinone oxidoreductase 17.2 kD subunit [Mesorhizobium sp. BNC1] | 110634071 | 9.00E-58 | Mesorhizobium sp. BNC1 | Drosophila melanogaster polypeptide SEQ ID NO 24465. | ABB59730 | 3.00E-09 | Prokaryotic essential gene #34740. | ACA34135 | 3.9 | 1.6.99.3 | 396 | 131 | 0 | 132 | 73 | |
| 695, 696 | FAD dependent oxidoreductase [Ralstonia eutropha H16] | 116695075 | 1.00E-141 | Ralstonia eutropha H16 | Pseudomonas aeruginosa polypeptide #3. | ABO71517 | 1.00E-121 | Pseudomonas aeruginosa polypeptide #3. | ABD05088 | 1.00E-12 | 1.1.99. | 1164 | 387 | 0 | 388 | 63 | |
| 697, 698 | Glycine/D-amino acid oxidase [Magnetospirillum magneticum AMB-1] | 83311898 | 1.00E-103 | Magnetospirillum magneticum AMB-1 | P. aeruginosa virulence gene VIR14, protein. | ADQ03060 | 2.00E-50 | Bacterial polypeptide #10001. | ADT43170 | 0.001 | 1.4.99.1 | 1257 | 418 | 0 | 422 | 47 | |
| 699, 700 | FAD dependent oxidoreductase [Nitrobacter winogradskyi Nb-255] | 75676467 | 1.00E-119 | Nitrobacter winogradskyi Nb-255 | Glyphosate oxidoreductase gene downstream flanking region. | AAR22262 | 1.00E-41 | Prokaryotic essential gene #34740. | ACA26065 | 0.015 | 1.4.99.1 | 1245 | 414 | 0 | 417 | 52 | |
| 701, 702 | D-aspartate oxidase [Stigmatella aurantiaca DW4/3-1] gi|115366155|gb|EAU65167.1| D-aspartate oxidase [Stigmatella aurantiaca DW4/3-1] | 115376852 | 8.00E-51 | Stigmatella aurantiaca DW4/3-1 | Human D-aspartate oxidase active site. | AED18771 | 6.00E-44 | Drosophila melanogaster polypeptide SEQ ID NO 24465. | ABL13112 | 0.18 | 1.4.3.3 | 981 | 326 | 0 | 314 | 39 | |
| 703, 704 | FAD dependent oxidoreductase [Rhodopseudomonas palustris BisB5] | 91976294 | 1.00E-118 | Rhodopseudomonas palustris BisB5 | Glyphosate oxidoreductase gene downstream flanking region. | AAR22262 | 6.00E-44 | Hyperthermophile Methanopyrus kandleri protein #28. | ADM27081 | 0.23 | 1.4.99.1 | 1248 | 415 | 0 | 417 | 50 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 705, 706 | putative oxidoreductase protein [Bradyrhizobium japonicum USDA 110] | 27379412 | 1.00E-133 | Bradyrhizobium japonicum USDA 110 | Glyphosate oxidoreductase gene downstream flanking region. | AAR22262 | 1.00E-42 | Pseudomonas aeruginosa polypeptide #3. | ABD08105 | 0.23 | 1.4.99.1 | 1233 | 410 | 0 | 410 | 56 | |
| 707, 708 | FAD dependent oxidoreductase [Nitrobacter winogradskyi Nb-255] | 75676467 | 1.00E-121 | Nitrobacter winogradskyi Nb-255 | Glyphosate oxidoreductase gene downstream flanking region. | AAR22262 | 6.00E-52 | S. mansoni protein SEQ ID 18. | ADY66589 | 0.06 | 1.4.99.1 | 1275 | 424 | 0 | 417 | 52 | |
| 709, 710 | FAD dependent oxidoreductase [Burkholderia phymatum STM815] | 118034565 | 0 | Burkholderia phymatum STM815 | Glyphosate oxidoreductase gene downstream flanking region. | AAR22262 | 2.00E-49 | Bacterial polypeptide #10001. | ADT43021 | 0.23 | 1.4.99.1 | 1233 | 410 | 0 | 410 | 75 | |
| 711, 712 | FAD dependent oxidoreductase [Alkalilimnicola ehrlichei MLHE-1] gi|117979745|gb|EAU94152.1| | 114319576 | 1.00E-88 | Alkalilimnicola ehrlichei MLHE-1 | P. aeruginosa virulence gene VIR14, protein. | ADQ03060 | 2.00E-81 | Rice protein conferring disease resistance in plants/ | ADA48957 | 0.23 | 1.4.99.1 | 1266 | 421 | 0 | 421 | 43 | |
| 713, 714 | FAD dependent oxidoreductase [Burkholderia phymatum STM815] | 118034565 | 0 | Burkholderia phymatum STM815 | Glyphosate oxidoreductase gene downstream flanking region. | AAR22262 | 2.00E-49 | Bacterial polypeptide #10001. | ADT43021 | 0.23 | 1.4.99.1 | 1233 | 410 | 0 | 410 | 75 | |
| 715, 716 | FAD dependent oxidoreductase [Burkholderia phymatum STM815] gi|117979745|gb|EAU94152.1| FAD dependent oxidoreductase [Magnetospirillum gryphiswaldense MSR-1] | 144897812 | 4.00E-87 | Magnetospirillum gryphiswaldense MSR-1 | Glyphosate oxidoreductase gene downstream flanking region. | ABO75104 | 4.00E-80 | Human acute myeloid leukemia prognosis target gene PCR primer #247. | AET00128 | 0.91 | 1.4.99.1 | 1251 | 416 | 0 | 420 | 43 | |

APPENDIX 1-continued

| SEQ ID NO: | NR Description | NR Accession Code | NR Evalue | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|
| 717, 718 | FAD dependent oxidoreductase, putative [*Microscilla marina* ATCC 23134] gi|123987451|gb|EAY27171.1| | 124006998 | 1.00E−29 | H. pylori GHPO 1099 gene. | AAW98270 | 0.87 | | | | 912 | 303 | 0 | 358 | 29 | |
| 719, 720 | FAD dependent oxidoreductase, putative [*Microscilla marina* ATCC 23134] FAD dependent oxidoreductase [*Nitrobacter winogradskyi* Nb-255] | 15676467 | 1.00E−137 | Glyphosate oxidoreductase gene downstream flanking region. | AAR22262 | 6.00E−51 | *Pseudomonas aeruginosa* polypeptide #3. | ABD10326 | 3.6 | 1.4.99.1 | 1251 | 416 | 0 | 417 | 57 | |
| 721, 722 | D-amino-acid oxidase [*Nocardioides sp.* JS614] gi|119536676|gb|ABL81293.1| D-amino-acid oxidase [*Nocardioides sp.* JS614] | 119716015 | 1.00E−53 | Human D-aspartate oxidase active stie. | AED18771 | 6.00E−40 | Bacterial polypeptide #10001. | ADT44787 | 0.042 | 1.4.3.3 | 918 | 305 | 0 | 310 | 42 | |
| 723, 724 | Glycine/D-amino acid oxidase [*Nitrococcus mobilis* Nb-231] gi|88791478|gb|EAR22589.1| Glycine/D-amino acid oxidase [*Nitrococcus mobilis* Nb-231] | 88810939 | 2.00E−84 | *Pseudomonas aeruginosa* polypeptide #3. | ABO75104 | 2.00E−77 | Human breast cancer expressed polynucleotide 8440. | AAL13181 | 0.001 | 1.4.99.1 | 1251 | 416 | 0 | 423 | 41 | |
| 725, 726 | FAD dependent oxidoreductase [*Dechloromonas aromatica* RCB] | 71909453 | 1.00E−133 | Enterobacter cloacae protein amino acid sequence - SEQ ID 5666. | AEH60497 | 4.00E−95 | Human ORFX protein sequence SEQ ID NO: 19716. | ABN17150 | 1.00E−12 | 1.4.99.1 | 1260 | 419 | 0 | 418 | 56 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 727, 728 | D-amino acid dehydrogenase small subunit [Marinobacter algicola DG893] | 149377918 | 1.00E-136 | Marinobacter algicola DG893 | Photorhabdus luminescens protein sequence #59. | ABM69115 | 7.00E-85 | Drosophila melanogaster polypeptide SEQ ID NO 24465. | ABL15242 | 3.9 | 1.4.99.1 | 1329 | 442 | 0 | 423 | 56 | |
| 729, 730 | pyruvate flavodoxin/ferredoxin oxidoreductase domain protein [Alkalilimnicola ehrlichei MLHE-1] | 114319858 | 1.00E-135 | Alkalilim-nicola ehrlichei MLHE-1 | Staphylococcus aureus protein #10. | ABM73103 | 1.00E-57 | Pseudomonas aeruginosa polypeptide #3. | ABD01828 | 0.051 | 1.2.7.3 | 1098 | 365 | 0 | 576 | 65 | |
| 731, 732 | FAD dependent oxidoreductase [Magnetospirillum gryphiswaldense MSR-1] | 144897812 | 4.00E-80 | Magneto-spirillum gryphiswal-dense MSR-1 | Klebsiella pneumoniae polypeptide seqid 7178. | ABO67618 | 4.00E-62 | Human breast cancer expressed polynucleotide 8440. | AAL13181 | 1.00E-06 | 1.4.99.1 | 1260 | 419 | 0 | 420 | 41 | |
| 733, 734 | FAD dependent oxidoreductase [Magnetospirillum gryphiswaldense MSR-1] | 144897812 | 1.00E-89 | Magneto-spirillum gryphiswal-dense MSR-1 | Pseudomonas aeruginosa polypeptide #3. | ABO75104 | 8.00E-76 | Bacterial polypeptide #10001. | ADS63429 | 0.23 | 1.4.99.1 | 1257 | 418 | 0 | 420 | 44 | |
| 735, 736 | FAD linked oxidase domain protein [Methylobacterium sp. 4-46] | 149124512 | 3.00E-61 | Methylo-bacterium sp. 4-46 | FAD-dependent-D-erythronate 4-phosphate dehydrogenase. | ADM97925 | 2.00E-57 | M. xanthus protein sequence, seq id 9726. | ACL64584 | 2.00E-06 | 1.1.2.4 | 807 | 268 | 0 | 477 | 48 | |
| 737, 738 | FAD dependent oxidoreductase [Chromohalobacter salexigens DSM 3043] | 92113847 | 1.00E-150 | Chromo-halobacter salexigens DSM 3043 | Glyphosate oxidoreductase gene downstream flanking region. | AAR20642 | 2.00E-43 | Pseudomonas aeruginosa polypeptide #3. | ABD10634 | 0.058 | 1.4.99.1 | 1242 | 413 | 0 | 414 | 62 | |
| 739, 740 | FAD dependent oxidoreductase [Chromohalobacter salexigens DSM 3043] | 92113847 | 1.00E-153 | Chromo-halobacter salexigens DSM 3043 | Glyphosate oxidoreductase gene downstream flanking region. | AAR22262 | 6.00E-41 | Human secreted protein-encoding gene 29 cDNA clone HCEFl77, SEQ ID NO: 103. | AAD07816 | 0.91 | 1... | 1245 | 414 | 0 | 414 | 63 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 741, 742 | FAD dependent oxidoreductase [Chromohalobacter salexigens DSM 3043] | 92113847 | 1.00E-153 | Chromohalobacter salexigens DSM 3043 | Glyphosate oxidoreductase gene downstream flanking region. | AAR22262 | 6.00E-41 | Human secreted protein-encoding gene 29 cDNA clone HCEFI77, SEQ ID NO: 103. | AAD07816 | 0.91 | 1... | 1245 | 414 | 0 | 414 | 63 | |
| 743, 744 | FAD dependent oxidoreductase [Chromohalobacter salexigens DSM 3043] | 92113847 | 1.00E-150 | Chromohalobacter salexigens DSM 3043 | Glyphosate oxidoreductase gene downstream flanking region. | AAR20642 | 6.00E-43 | Pseudomonas aeruginosa polypeptide #3. | ABD10634 | 0.058 | 1.4.99.1 | 1242 | 413 | 0 | 414 | 62 | |
| 745, 746 | FAD dependent oxidoreductase [Ralstonia metallidurans CH34] | 94314005 | 1.00E-101 | Ralstonia metallidurans CH34 | Pseudomonas aeruginosa polypeptide #3. | ABO71517 | 6.00E-85 | E. coli NCg12640 DNA. | AER28868 | 0.83 | 1.1.99. | 1146 | 381 | 0 | 385 | 49 | |
| 747, 748 | glycine/D-amino acid oxidase [Parvibaculum lavamentivorans DS-1] gi\|121298521\|gb\|EAX39710.1\| glycine/D-amino acid oxidase [Parvibaculum lavamentivorans DS-1] | 121525574 | 1.00E-125 | Parvibaculum lavamentivorans DS-1 | P. aeruginosa virulence gene VIR14, protein. | ADQ03060 | 6.00E-76 | Pseudomonas aeruginosa polypeptide #3. | ABD08815 | 0.015 | 1.4.99.1 | 1278 | 425 | 0 | 462 | 53 | |
| 749, 750 | FAD dependent oxidoreductase [Dechloromonas aromatica RCB] | 71909453 | 1.00E-139 | Dechloromonas aromatica RCB | P. aeruginosa virulence gene VIR14, protein. | ADQ03060 | 2.00E-96 | Human breast cancer expressed polynucleotide 8440. | AAL13181 | 2.00E-07 | 1.4.99.1 | 1245 | 414 | 0 | 418 | 60 | |
| 751, 752 | monooxygenase, FAD-binding [Comamonas testosteroni KF-1] gi\|118002385\|gb\|EAV16539.1\| monooxygenase, FAD-binding [Comamonas testosteroni KF-1] | 118050299 | 8.00E-81 | Comamonas testosteroni KF-1 | Farnesyl dibenzo-diazepinone biosynthetic ORF9 protein HMGA, SEQ ID 18. | ADR01274 | 6.00E-18 | Prokaryotic essential gene #34740. | ACA23297 | 0.65 | 1.14.13. | 915 | 304 | 0 | 543 | 49 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 753, 754 | FAD dependent oxidoreductase [Nitrobacter winogradskyi Nb-255] | 75676467 | 1.00E-120 | Nitrobacter winogradskyi Nb-255 | Glyphosate oxidoreductase gene downstream flanking region. | AAR22262 | 3.00E-53 | Human nucleic acid-associated protein NAAP-13 SEQ ID NO: 13. | ADD01267 | 0.23 | 1.4.99.1 | 1248 | 415 | 0 | 417 | 52 | |
| 755, 756 | FAD dependent oxidoreductase [Rhodopseudomonas palustris BisB5] | 91976294 | 1.00E-121 | Rhodopseudomonas palustris BisB5 | Glyphosate oxidoreductase gene downstream flanking region. | AAR22262 | 1.00E-54 | | | 0 | 1.4.99.1 | 1245 | 414 | 0 | 417 | 51 | |
| 757, 758 | putative oxidoreductase protein [Sagittula stellae E-37] gi|126707413|gb|EBA06477.1| putative oxidoreductase protein [Sagittula stellae E-37] | 126732124 | 1.00E-131 | Sagittula stellae E-37 | Glyphosate oxidoreductase gene downstream flanking region. | AAR22262 | 1.00E-31 | Human prostate cancer associated polypeptide SeqID273. | ADJ09909 | 3.6 | 1.4.99.1 | 1251 | 416 | 0 | 410 | 55 | |
| 759, 760 | FAD dependent oxidoreductase [Nitrobacter winogradskyi Nb-255] | 75676467 | 1.00E-113 | Nitrobacter winogradskyi Nb-255 | Glyphosate oxidoreductase gene downstream flanking region. | AAR22262 | 2.00E-51 | Human PRO protein amino acid sequence - SEQ ID 59. | AEH18256 | 0.23 | 1.4.99.1 | 1254 | 417 | 0 | 417 | 49 | |
| 761, 762 | FAD dependent oxidoreductase [Chromohalobacter salexigens DSM 3043] | 92113847 | 1.00E-149 | Chromohalobacter salexigens DSM 3043 | Glyphosate oxidoreductase gene downstream flanking region. | AAR20642 | 2.00E-42 | Nocardiopsis alba copper stable protease 08. | ADR47152 | 0.23 | 1.4.99.1 | 1242 | 413 | 0 | 414 | 62 | |
| 763, 764 | FAD dependent oxidoreductase [Alkalilimnicola ehrlichei MLHE-1] | 114319576 | 4.00E-84 | Alkalilimnicola ehrlichei MLHE-1 | Pseudomonas aeruginosa polypeptide #3. | ABO75104 | 9.00E-80 | Human breast cancer expressed polynucleotide 8440. | AAL13181 | 0.001 | 1.4.99.1 | 1251 | 416 | 0 | 421 | 41 | |
| 765, 766 | FAD linked oxidase domain protein [Methylobacterium sp. 4-46] | 149124512 | 1.00E-106 | Methylobacterium sp. 4-46 | FAD-dependent-D-erythronate 4-phosphate dehydrogenase. | ADM97925 | 1.00E-94 | Bacterial polypeptide #10001. | ADS59768 | 9.00E-07 | 1.1.2.4 | 1182 | 393 | 0 | 477 | 51 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 767, 768 | FAD dependent oxidoreductase [Alkalilimnicola ehrlichei MLHE-1] | 114319576 | 3.00E-84 | Alkalilimnicola ehrlichei MLHE-1 | Pseudomonas aeruginosa polypeptide #3. | ABO75104 | 2.00E-75 | Human breast cancer expressed polynucleotide 8440. | AAL13181 | 0.015 | 1.4.99.1 | 1257 | 418 | 0 | 421 | 41 | |
| 769, 770 | FAD dependent oxidoreductase [Chromohalobacter salexigens DSM 3043] | 92113847 | 1.00E-149 | Chromohalobacter salexigens DSM 3043 | Glyphosate oxidoreductase gene downstream flanking region. | AAR20642 | 2.00E-42 | Prokaryotic essential gene #34740. | ACA37735 | 0.015 | 1.4.99.1 | 1242 | 413 | 0 | 414 | 62 | |
| 771, 772 | FAD dependent oxidoreductase [Nitrobacter winogradskyi Nb-255] | 75676467 | 1.00E-121 | Nitrobacter winogradskyi Nb-255 | Glyphosate oxidoreductase gene downstream flanking region. | AAR22262 | 6.00E-54 | Pseudomonas aeruginosa polypeptide #3. | ABD1413 | 0.91 | 1.4.99.1 | 1245 | 414 | 0 | 417 | 53 | |
| 773, 774 | FAD dependent oxidoreductase [Chromohalobacter salexigens DSM 3043] | 92113847 | 1.00E-149 | Chromohalobacter salexigens DSM 3043 | Glyphosate oxidoreductase gene downstream flanking region. | AAR22262 | 3.00E-42 | Nocardiopsis alba copper stable protease 08. | ADR47152 | 0.23 | 1.4.99.1 | 1242 | 413 | 0 | 414 | 62 | |
| 775, 776 | Glycine/D-amino acid oxidase [Nitrococcus mobilis Nb-231] gi|88791478|gb|EAR22589.1| Glycine/D-amino acid oxidase [Nitrococcus mobilis Nb-231] | 88810939 | 5.00E-77 | Nitrococcus mobilis Nb-231 | N. gonorrhoeae nucleotide sequence SEQ ID 4691. | ABP30542 | 7.00E-64 | Aspergillus fumigatus essential gene protein #821. | ABT17832 | 3.7 | 1.4.99.1 | 1272 | 423 | 0 | 423 | 38 | |
| 777, 778 | putative oxidoreductase protein [Bradyrhizobium japonicum USDA 110] | 27379412 | 0 | Bradyrhizobium japonicum USDA 110 | Glyphosate oxidoreductase gene downstream flanking region. | AAR22262 | 3.00E-42 | Prokaryotic essential gene #34740. | ACA26366 | 0.9 | 1.4.99.1 | 1233 | 410 | 0 | 410 | 92 | |
| 779, 780 | FAD dependent oxidoreductase [Burkholderia phytofirmans PsJN] gi|117992233|gb|EAV06525.1| FAD dependent oxidoreductase | 118037424 | 0 | Burkholderia phytofirmans PsJN | Glyphosate oxidoreductase gene downstream flanking region. | AAR22262 | 5.00E-49 | Rice abiotic stress responsive polypeptide SEQ ID NO: 4152. | ACL30152 | 0.23 | 1.4.99.1 | 1233 | 410 | 0 | 465 | 86 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 781, 782 | FAD dependent oxidoreductase [Stappia aggregata IAM 12614] gi\|118434190\|gb\|EAV40846.1\| FAD dependent oxidoreductase [Stappia aggregata IAM 12614] | 118593299 | 1.00E-122 | Stappia aggregata IAM 12614 | Glyphosate oxidoreductase gene downstream flanking region. | AAR22262 | 2.00E-47 | Stress tolerant plant-related transcription factor protein SeqID10. | AEA26962 | 0.06 | 1.4.99.1 | 1272 | 423 | 0 | 422 | 52 | |
| 783, 784 | FAD linked oxidase domain protein [Methylobacterium sp. 4-46] | 149124512 | 7.00E-99 | Methylobacterium sp. 4-46 | FAD-dependent-D-erythronate 4-phosphate dehydrogenase. | ADM97925 | 9.00E-89 | Bacterial polypeptide #10001. | ADT42301 | 9.00E-10 | 1.1.2.4 | 1137 | 378 | 0 | 477 | 51 | |
| 785, 786 | FAD dependent oxidoreductase [Alkalilimnicola ehrlichei MLHE-1] | 114319576 | 1.00E-84 | Alkalilimnicola ehrlichei MLHE-1 | Pseudomonas aeruginosa polypeptide #3. | ABO75104 | 3.00E-76 | Pseudomonas aeruginosa polypeptide #3. | ABD08815 | 0.001 | 1.4.99.1 | 1251 | 416 | 0 | 421 | 41 | |
| 787, 788 | FAD dependent oxidoreductase [Magnetospirillum gryphiswaldense MSR-1] | 144897812 | 9.00E-85 | Magnetospirillum gryphiswaldense MSR-1 | Pseudomonas aeruginosa polypeptide #3. | ABO75104 | 2.00E-81 | Human breast cancer expressed polynucleotide 8440. | AAL13181 | 0.001 | 1.4.99.1 | 1251 | 416 | 0 | 420 | 42 | |
| 789, 790 | putative oxidoreductase protein [Sagittula stellata E-37] gi\|126707413\|gb\|EBA06477.1\| putative oxidoreductase protein [Sagittula stellata E-37] | 126732124 | 1.00E-107 | Sagittula stellata E-37 | Glyphosate oxidoreductase gene downstream flanking region. | AAR22262 | 1.00E-40 | Prokaryotic essential gene #34740. | ACA39870 | 0.23 | 1.4.99.1 | 1248 | 415 | 0 | 410 | 46 | |
| 791, 792 | Oxidoreductase, N-terminal: Dihydrodipicolinate reductase [Halothermothrix orenii H 168] gi\|89158855\|gb\|E | 89211549 | 2.00E-98 | Halothermothrix orenii H 168 | Propionibacterium acnes predicted ORF-encoded polypeptide #300. | ABM37055 | 9.00E-80 | Human soft tissue sarcoma-upregulated protein - SEQ ID 40. | ADQ24247 | 3 | 1.3.1.26 | 1044 | 347 | 0 | 333 | 50 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | AR78543.1 Oxidoreductase, N-terminal: Dihydrodipicolinate reductase [Halothermothrix orenii H 168] | | | | | | | | | | | | | | | | |
| 793, 794 | PUTATIVE OXIDO-REDUCTASE PROTEIN [Sinorhizobium meliloti] | 15964495 | 1.00E-149 | Sinorhizobium meliloti | Glyphosate oxidoreductase gene downstream flanking region. | AAR22262 | 8.00E-46 | Plant polypeptide, SEQ ID 5546. | ADT18820 | 0.004 | 1. . . | 1233 | 410 | 1254 | 417 | 63 | 65 |
| 795, 796 | indolepyruvate ferredoxin oxidoreductase [Stappia aggregata IAM 12614] gi\|118434188\|gb\|EAV40844.1\| indolepyruvate ferredoxin oxidoreductase [Stappia aggregata IAM 12614] | 118593297 | 0 | Stappia aggregata IAM 12614 | Acinetobacter baumannii protein #19. | ADA35170 | 0 | Silicibacter sp. TM1040 gene SEQ ID NO: 3. | AEM45684 | 0.007 | 1.2.7.8 | 2313 | 770 | 0 | 1173 | 61 | |
| 797, 798 | FAD linked oxidase domain protein [Methylobacterium sp. 4-46] | 149124512 | 1.00E-128 | Methylobacterium sp. 4-46 | FAD-dependent-D-erythronate 4-phosphate dehydrogenase. | ADM97925 | 1.00E-113 | Bacterial polypeptide #10001. | ADT47055 | 1.00E-06 | 1.1.2.4 | 1437 | 478 | 0 | 477 | 53 | |
| 799, 800 | FAD dependent oxidoreductase [Alkalilimnicola ehrlichei MLHE-1] | 114319576 | 9.00E-90 | Alkalilimnicola ehrlichei MLHE-1 | M. catarrhalis protein #1. | ADL05210 | 4.00E-63 | Human endothelial cell cDNA #2412. | ACH13524 | 0.015 | 1.4.99.1 | 1281 | 426 | 0 | 421 | 42 | |
| 801, 802 | FAD dependent oxidoreductase [Magnetospirillum gryphiswaldense MSR-1] | 144897812 | 1.00E-89 | Magnetospirillum gryphiswaldense MSR-1 | Pseudomonas aeruginosa polypeptide #3. | ABO75104 | 8.00E-76 | Bacterial polypeptide #10001. | ADS63429 | 0.23 | 1.4.99.1 | 1257 | 418 | 0 | 420 | 44 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 803, 804 | FAD dependent oxidoreductase [Alkalilimnicola ehrlichei MLHE-1] | 114319576 | 1.00E-86 | Alkalilimnicola ehrlichei MLHE-1 | P. aeruginosa virulence gene VIR14, protein. | ADQ03060 | 4.00E-78 | Plant cDNA #31. | ADJ41976 | 0.92 | 1.4.99.1 | 1257 | 418 | 0 | 421 | 42 | |
| 805, 806 | FAD linked oxidase domain protein [Methylobacterium sp. 4-46] | 149124512 | 1.00E-121 | Methylobacterium sp. 4-46 | FAD-dependent-D-erythronate 4-phosphate dehydrogenase. | ADM97925 | 1.00E-104 | N. gonorrhoeae nucleotide sequence SEQ ID 4691. | ABZ40619 | 4.00E-09 | 1.1.2.4 | 1323 | 440 | 0 | 477 | 53 | |
| 807, 808 | D-amino acid dehydrogenase small subunit [Marinobacter algicola DG893] | 149377918 | 1.00E-135 | Marinobacter algicola DG893 | Photorhabdus luminescens protein sequence #59. | ABM69115 | 5.00E-84 | Novel human polynucleotide, SEQ ID NO: 1975. | AAF66669 | 0.25 | 1.4.99.1 | 1329 | 442 | 0 | 423 | 55 | |
| 809, 810 | FAD dependent oxidoreductase [Burkholderia phytofirmans PsJN] gi|117991720|gb|EAV06013.1| FAD dependent oxidoreductase [Burkholderia phytofirmans PsJN] | 118038076 | 0 | Burkholderia phytofirmans PsJN | Glyphosate oxidoreductase gene downstream flanking region. | AAR22262 | 6.00E-46 | Bifidobacterium longum NCC2705 ORF amino acid sequence SEQ ID NO: 408. | ABQ81849 | 0.91 | 1.4.99.1 | 1242 | 413 | 0 | 413 | 81 | |
| 811, 812 | FAD dependent oxidoreductase [Burkholderia phytofirmans PsJN] gi|117991720|gb|EAV06013.1| FAD dependent oxidoreductase [Burkholderia phytofirmans PsJN] | 118038076 | 0 | Burkholderia phytofirmans PsJN | Glyphosate oxidoreductase gene downstream flanking region. | AAR22262 | 6.00E-46 | Bifidobacterium longum NCC2705 ORF amino acid sequence SEQ ID NO: 408. | ABQ81849 | 0.91 | 1.4.99.1 | 1242 | 413 | 0 | 413 | 81 | |
| 813, 814 | FAD dependent oxidoreductase [Burkholderia phytofirmans PsJN] gi|117991720|gb|EAV06013.1| FAD dependent | 118038076 | 0 | Burkholderia phytofirmans PsJN | Glyphosate oxidoreductase gene downstream flanking region. | AAR22262 | 6.00E-46 | Bifidobacterium longum NCC2705 ORF amino acid sequence SEQ ID | ABQ81849 | 0.91 | 1.4.99.1 | 1242 | 413 | 0 | 413 | 81 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | oxidoreductase [Burkholderia phytofirmans PsJN] | | | | | | | NO: 408. | | | | | | | | | |
| 815, 816 | FAD dependent oxidoreductase [Burkholderia phytofirmans PsJN] gi|117991720|gb|EAV06013.1| FAD dependent oxidoreductase [Burkholderia phytofirmans PsJN] | 118038076 | 0 | Burkholderia phytofirmans PsJN | Glyphosate oxidoreductase gene downstream flanking region. | AAR22262 | 6.00E-46 | Bifidobacterium longum NCC2705 ORF amino acid sequence SEQ ID NO: 408. | ABQ81849 | 0.91 | 1.4.99.1 | 1242 | 413 | 0 | 413 | 81 | |
| 817, 818 | FAD dependent oxidoreductase [Alkalilimnicola ehrlichei MLHE-1] | 114319576 | 5.00E-93 | Alkalilimnicola ehrlichei MLHE-1 | P. aeruginosa virulence gene VIR14, protein. | ADQ03060 | 1.00E-79 | Enterobacter cloacae protein amino acid sequence - SEQ ID 5666. | AEH53102 | 0.004 | 1.4.99.1 | 1269 | 422 | 0 | 421 | 43 | |
| 819, 820 | FAD dependent oxidoreductase [Magnetospirillum gryphiswaldense MSR-1] | 144897812 | 1.00E-124 | Magnetospirillum gryphiswaldense MSR-1 | P. aeruginosa virulence gene VIR14, protein. | ADQ03060 | 2.00E-99 | Human ORFX protein sequence SEQ ID NO: 19716. | ABN17150 | 0.015 | 1.4.99.1 | 1263 | 420 | 0 | 420 | 54 | |
| 821, 822 | FAD dependent oxidoreductase [Chromohalobacter salexigens DSM 3043] | 92113847 | 1.00E-150 | Chromohalobacter salexigens DSM 3043 | Glyphosate oxidoreductase gene downstream flanking region. | AAR20642 | 2.00E-43 | Pseudomonas aeruginosa polypeptide #3. | ABD10634 | 0.058 | 1.4.99.1 | 1242 | 413 | 0 | 414 | 62 | |
| 823, 824 | hypothetical protein, contains weak similarity to sarcosine oxidase [Mesorhizobium loti]. | 13473721 | 1.00E-176 | Mesorhizobium loti | Human Her-2/neu over expression modulated protein (HOMPS) H14 cDNA. | AAE00797 | 2.00E-76 | Human catalyc telomerase sub-unit PCR primer HTR2BAM. | AAV72125 | 2.00E-04 | 1.5.3.1 | 1170 | 389 | 1167 | 388 | 77 | |
| 825, 826 | FAD dependent oxidoreductase [Delftia acidovorans SPH-1] gi|118668198|gb| | 118731339 | 0 | Delftia acidovorans SPH-1 | Pseudomonas aeruginosa polypeptide #3. | ABO71517 | 1.00E-100 | Pseudomonas aeruginosa polypeptide #3. | ABD04986 | 1.00E-12 | 1.1.99. | 1146 | 381 | 0 | 385 | 90 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | EAV74793.1\| FAD dependent oxidoreductase [Delftia acidovorans SPH-1] | | | | | | | | | | | | | | | | |
| 827, 828 | FAD dependent oxidoreductase [Stappia aggregata IAM 12614] gi\|118434190\|gb\|EAV40846.1\| FAD dependent oxidoreductase [Stappia aggregata IAM 12614] | 118593299 | 1.00E-122 | Stappia aggregata IAM 12614 | Glyphosate oxidoreductase gene downstream flanking region. | AAR22262 | 2.00E-47 | Stress tolerant plant-related transcription factor protein SeqID10. | AEA26962 | 0.06 | 1.4.99.1 | 1272 | 423 | 0 | 422 | 52 | |
| 829, 830 | FAD dependent oxidoreductase [Alkalilimnicola ehrlichei MLHE-1] | 114319576 | 2.00E-87 | Alkalilim- nicola ehrlichei MLHE-1 | Pseudomonas aeruginosa polypeptide #3. | ABO75104 | 1.00E-66 | Pseudomonas aeruginosa polypeptide #3. | ABD08815 | 6.00E-05 | 1.4.99.1 | 1281 | 426 | 0 | 421 | 40 | |
| 831, 832 | hypothetical protein [Mesorhizobium loti] | 13475565 | 7.00E-99 | Mesorhizo- bium loti | Pseudomonas aeruginosa polypeptide #3. | ABO71517 | 1.00E-78 | Pseudomonas aeruginosa polypeptide #3. | ADB04986 | 2.00E-11 | 1.1.99. | 1137 | 378 | 1152 | 383 | 49 | 59 |
| 833, 834 | FAD dependent oxidoreductase [Magneto- spirillum gryphiswaldense MSR-1] | 144897812 | 2.00E-89 | Magneto- spirillum gryphiswal- dense MSR-1 | Pseudomonas aeruginosa polypeptide #3. | ABO75104 | 8.00E-76 | Bacterial polypeptide #10001. | ADS63429 | 0.23 | 1.4.99.1 | 1257 | 418 | 0 | 420 | 44 | |
| 835, 836 | FAD linked oxidase domain protein [Methylobacte- rium sp. 4-46] | 149124512 | 1.00E-123 | Methylo- bacterium sp. 4-46 | FAD- dependent-D- erythronate 4- phosphate dehydrogenase. | ADM97925 | 1.00E-110 | Bacterial polypeptide #10001. | ADS56646 | 8.00E-14 | 1.1.2.4 | 1395 | 464 | 0 | 477 | 52 | |
| 837, 838 | D-aspartate oxidase [Stigmatella aurantiaca DW4/3-1] gi\|115366155\|gb\|EAU65167.1\| | 115376852 | 1.00E-56 | Stigmatella aurantiaca DW4/3-1 | Human D-aspartate oxidase active site. | AED18771 | 8.00E-45 | Acinetobacter species rpoB gene SEQ ID NO: 19. | AEK59509 | 0.68 | 1.4.3.1 | 942 | 313 | 0 | 314 | 39 | |

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | D-aspartate oxidase [Stigmatella aurantiaca DW4/3-1] | | | | | | | | | | | | | | | | |
| 839, 840 | FAD dependent oxidoreductase [Burkholderia phytofirmans PsJN] gi|117991720|gb| EAV06013.1| FAD dependent oxidoreductase [Burkholderia phytofirmans PsJN] | 118038076 | 0 | Burkholderia phytofirmans PsJN | Glyphosate oxidoreductase gene downstream flanking region. | AAR22262 | 6.00E-46 | Bifidobacterium longum NCC2705 ORF amino acid sequence SEQ ID NO: 408. | ABQ81849 | 0.91 | 1.4.99.1 | 1242 | 413 | 0 | 413 | 81 | |
| 841, 842 | FAD dependent oxidoreductase [Dechloromonas aromatica RCB] | 71909453 | 1.00E-126 | Dechloromonas aromatica RCB | P. aeruginosa virulence gene VIR14, protein. | ADQ03060 | 9.00E-93 | Human ORFX protein sequence SEQ ID NO.: 19716 | ABN17150 | 2.00E-05 | 1.4.99.1 | 1269 | 422 | 0 | 418 | 52 | |
| 843, 844 | FAD dependent oxidoreductase [Burkholderia phymatum STM815] gi|117985258|gb| EAU99635.1| FAD dependent oxidoreductase [Burkholderia phymatum STM815] | 118029195 | 1.00E-180 | Burkholderia phymatum STM815 | Enterobacter cloacae protein amino acid sequence - SEQ ID 5666. | AEH60497 | 1.00E-171 | Pseudomonas aeruginosa polypeptide #3. | ABD08815 | 1.00E-43 | 1.4.99.1 | 1290 | 429 | 0 | 428 | 72 | |
| 845, 846 | putative oxidoreductase protein [Bradyrhizobium japonicum USDA 110] | 27379412 | 0 | Bradyrhizobium japonicum USDA 110 | Glyphosate oxidoreductase gene downstream flanking region. | AAR22262 | 1.00E-42 | Peptide #3 used for purifying peptidyl-tRNA hydrolase (PTH) protein. | AAD56788 | 0.23 | 1.4.99.1 | 1233 | 410 | 0 | 410 | 93 | |
| 847, 848 | FAD dependent oxidoreductase [Pseudomonas fluorescens PfO-1] | 77457196 | 1.00E-171 | Pseudomonas fluorescens PfO-1 | Pseudomonas aeruginosa polypeptide #3. | ADQ03060 | 7.00E-80 | Pseudomonas aeruginosa polypeptide #3. | ABD05088 | 2.00E-51 | 1.1.99. | 1131 | 376 | 0 | 375 | 77 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 849, 850 | FAD dependent oxidoreductase [Alkalilimnicola ehrlichei MLHE-1] | 114319576 | 7.00E-93 | Alkalilim- nicola ehrlichei MLHE-1 | P. aeruginosa virulence gene VIR14, protein. | | | Enterobacter cloacae protein amino acid sequence - SEQ ID 5666. | AEH53102 | 0.004 | 1.4.99.1 | 1269 | 422 | 0 | 421 | 43 | |
| 851, 852 | D-amino acid oxidase [Arthrobacter protophormiae]. | 32140775 | 1.00E-62 | Arthrobacter protophor- miae | Primer Aprev4 #SEQ ID 8. | ADF68144 | 4.00E-63 | Myco- bacterium tuberculosis strain H37Rv genome SEQ ID NO 2. | AAI99682 | 0.18 | 1.4.3.3 | 975 | 324 | 4E+06 | 326 | 77 | |
| 853, 854 | FAD dependent oxidoreductase [Pseudomonas fluorescens PfO-1] | 77457196 | 1.00E-171 | Pseudomonas fluorescens PfO-1 | Pseudomonas aeruginosa polypeptide #3. | ABO71517 | 1.00E-151 | Pseudomonas aeruginosa polypeptide #3. | ABD05088 | 2.00E-51 | 1.1.99. | 1131 | 376 | 0 | 375 | 99 | |
| 855, 856 | FAD dependent oxidoreductase [Comamonas testosteroni KF-1 gi\|118001016\|gb\|EAV15172.1\| FAD dependent oxidoreductase [Comamonas testosteroni KF-1] | 118051673 | 0 | Comamonas testosteroni KF-1 | Pseudomonas aeruginosa polypeptide #3. | ABO71517 | 1.00E-99 | Pseudomonas aeruginosa polypeptide #3. | ABD04986 | 1.00E-05 | 1.1.99. | 1173 | 390 | 0 | 390 | 99 | |
| 857, 858 | FAD dependent oxidoreductase [Comamonas testosteroni KF-1 gi\|118001016\|gb\|EAV15172.1\| FAD dependent oxidoreductase [Comamonas testosteroni KF-1] | 118051673 | 0 | Comamonas testosteroni KF-1 | Pseudomonas aeruginosa polypeptide #3. | ABO71517 | 1.00E-99 | Pseudomonas aeruginosa polypeptide #3. | ABD04986 | 1.00E-05 | 1.1.99. | 1173 | 390 | 0 | 390 | 99 | |
| 859, 860 | FAD dependent oxidoreductase [Comamonas testosteroni KF-1 gi\|118001016\|gb\| | 118051673 | 0 | Comamonas testosteroni KF-1 | Pseudomonas aeruginosa polypeptide #3. | ABO71517 | 1.00E-99 | Pseudomonas aeruginosa polypeptide #3. | ABD04986 | 1.00E-05 | 1.1.99. | 1173 | 390 | 0 | 390 | 99 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| | EAV15172.1| FAD dependent oxidoreductase [Comamonas testosteroni KF-1] | | | | | | | | | | | | | | | | |
| 861, 862 | D-amino acid oxidase [Rubrobacter xylanophilus DSM 9941] | 108803375 | 3.00E-70 | Rubrobacter xylanophilus DSM 9941 | Human D-aspartate oxidase active site. | AED18771 | 8.00E-62 | Yeast D-amino acid oxidase. | AED11687 | 5.00E-08 | 1.4.3.3 | 987 | 328 | 0 | 326 | 46 | |
| 863, 864 | D-amino acid dehydrogenase small subunit [Pseudomonas syringae pv. syringae B728a] | 66045305 | 0 | Pseudomonas syringae pv. syringae B728a | P. aeruginosa virulence gene VIR14, protein. | ADQ03060 | 0 | Pseudomonas aeruginosa polypeptide #3. | ABD08815 | 0 | 1.4.99.1 | 1299 | 432 | 0 | 433 | 88 | |
| 867, 868 | | | | Methanococcus maripaludis C7 | | ADS43070 | 3.00E-37 | | | 0.003 | 2.6.1.9 | 1062 | 353 | 12392 | 373 | 30 | 96 |
| 869, 870 | | | | | | AEM18037 | 1.00E-126 | | | 2.00E-25 | 2.6.1.21 | 852 | 283 | 1140 | 283 | 78 | 80 |
| 871, 872 | | | | Planctomyces maris DSM 8797 | | ADN26446 | 1.00E-95 | | | 1.1 | 5.4.3.8 | 1350 | 449 | 3784 | 417 | 46 | 96 |
| 873, 874 | | | | Planctomyces maris DSM 8797 | | ADN26446 | 7.00E-94 | | | 0.071 | 5.4.3.8 | 1401 | 466 | 1358 | 417 | 44 | 96 |
| 875, 876 | | | | Roseiflexus castenholzii DSM 13941 | | ADN26446 | 8.00E-98 | | | 1.00E-09 | 5.4.3.8 | 1344 | 447 | 37500 | 417 | 48 | 88 |
| 877, 878 | | | | Planctomyces maris DSM 8797 | | ADN26446 | 2.00E-94 | | | 0.018 | 5.4.3.8 | 1389 | 462 | 231 | 417 | 43 | 100 |
| 879, 880 | | | | Planctomyces maris DSM 8797 | | ADN26446 | 2.00E-93 | | | 0.018 | 5.4.3.8 | 1398 | 465 | 1356 | 417 | 43 | 96 |
| 881, 882 | | | | Oceanobacter sp. RED65 | | AEB37927 | 3.00E-50 | | | 2.7 | 2.6.1.21 | 873 | 290 | 1653 | 282 | 39 | 100 |
| 883, 884 | | | | Thiobacillus denitrificans ATCC 25259 | | AEM18040 | 2.00E-49 | | | | 2.6.1.21 | | 292 | | 283 | 42 | |
| 885, 886 | | | | Clostridium beijerinckii NCIMB 8052 | | EEM18031 | 2.00E-47 | | | 2.7 | 2.6.1.21 | 861 | 286 | 19976 | 283 | 40 | 100 |
| 887, 888 | | | | Nocardioides sp. JS614 | | AEK20408 | 3.00E-27 | | | 0.63 | 2.6.1.42 | 801 | 266 | 799 | 284 | 37 | 96 |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 889, 890 | | | | Methylococcus capsulatus str. Bath | | ABM71198 | 2.00E-53 | | | 0.66 | 2.6.1.21 | 840 | 279 | 264 | 282 | 41 | 100 |
| 891, 892 | | | | Clostridium beijerinckii NCIMB 8052 | | ABB08244 | 2.00E-47 | | | 0.67 | 2.6.1.21 | 861 | 286 | 599 | 283 | 39 | 100 |
| 893, 894 | | | | Clostridium beijerinckii NCIMB 8052 | | ABB08244 | 5.00E-46 | | | 0.17 | 2.6.1.21 | 861 | 286 | 44577 | 283 | 37 | 100 |
| 895, 896 | | | | Clostridium acetobutylicum ATCC 824 | | ABU32980 | 1.00E-45 | | | 0.66 | 2.6.1.21 | 849 | 282 | 16714 | 289 | 39 | 100 |
| 897, 898 | | | | Roseiflexus castenholzii DSM 13941 | | ADN26446 | 5.00E-93 | | | 7.00E-08 | 5.4.3.8 | 1353 | 450 | 1287 | 417 | 47 | 82 |
| 899, 900 | | | | Planctomyces maris DSM 8797 | | ADN26446 | 1.00E-100 | | | 1.00E-09 | 5.4.3.8 | 1362 | 453 | 37500 | 417 | 47 | 91 |
| 901, 902 | | | | Planctomyces maris DSM 8797 | | ADN26446 | 1.00E-104 | | | 0.001 | 5.4.3.8 | 1386 | 461 | 1341 | 417 | 49 | 96 |
| 903, 904 | | | | Planctomyces maris DSM 8797 | | ADN26446 | 7.00E-99 | | | 0.07 | 5.4.3.8 | 1383 | 460 | 870 | 417 | 47 | 84 |
| 905, 906 | | | | Rhodobacter sphaeroides 2.4.1 | | ADF03944 | 3.00E-68 | | | 2.7 | 2.6.1.21 | 864 | 287 | 5766 | 298 | 46 | 100 |
| 907, 908 | | | | Streptomyces avermitilis MA-4680 | | AEK20408 | 2.00E-33 | | | 0.042 | 2.6.1.42 | 831 | 276 | 591 | 284 | 36 | 100 |
| 909, 910 | | | | Bacillus sp. B14905 | | ADW43694 | 1.00E-159 | | | 0 | 2.6.1.21 | 855 | 284 | 1709 | 284 | 97 | 88 |
| 911, 912 | | | | Azoarcus sp. EbN1 | | ABU33175 | 4.00E-45 | | | 0.17 | 2.6.1.21 | 876 | 291 | 4862 | 278 | 36 | 100 |
| 913, 914 | | | | Bacillus licheniformis ATCC 14580 | | AEM18039 | 2.00E-56 | | | 2.6 | 2.6.1.21 | 852 | 283 | 7166 | 282 | 43 | 100 |
| 915, 916 | | | | Roseiflexus castenholzii DSM 13941 | | ADN26446 | 2.00E-87 | | | 2.00E-05 | 5.4.3.8 | 1383 | 460 | 1701 | 417 | 41 | 81 |
| 917, 918 | | | | Robiginitalea biformata HTCC2501 | | AAY13560 | 3.00E-48 | | | 0.72 | 2.6.1.21 | 915 | 304 | 652 | 282 | 39 | 100 |
| 919, 920 | | | | Planctomyces maris DSM 8797 | | ADN26446 | 1.00E-93 | | | 1.1 | 5.4.3.8 | 1350 | 449 | 18471 | 417 | 46 | 96 |
| 921, | | | | Planctomyces | | ADN26446 | 6.00E-96 | | | 0.07 | 5.4.3.8 | 1377 | 458 | 20250 | 417 | 48 | 100 |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 922 | | | | maris DSM 8797 | | | | | | | | | | | | | |
| 923, 924 | | | | Roseobacter sp. MED193 | | ADF03944 | 5.00E-75 | | | 2.7 | 2.6.1.21 | 861 | 286 | 864 | 298 | 50 | 100 |
| 925, 926 | | | | Planctomyces maris DSM 8797 | | ADN26446 | 1.00E-90 | | | 0.004 | 5.4.3.8 | 1377 | 458 | 1251 | 417 | 44 | 96 |
| 927, 928 | | | | Aquifex aeolicus VF5 | | ADN17496 | 0 | | | 0 | 2.6.1.1 | 1185 | 394 | 1185 | 394 | 100 | 100 |
| 929, 930 | | | | Aspergillus terreus NIH2624 | | ADS78245 | 0 | | | | 2.6.1.42 | | 322 | | 317 | 100 | |
| 931, 932 | | | | Oceanicola granulosus HTCC2516 | | ADS78325 | 0 | | | | 2.6.1.62 | | 519 | | 461 | 100 | |
| 933, 934 | | | | Pyrococcus horikoshii OT3 | | ADS41897 | 5.00E-53 | | | 3.8 | 2.6.1.1 | 1206 | 401 | 9502 | 387 | 33 | 100 |
| 935, 936 | | | | Aeromonas hydrophila subsp. hydrophila ATCC7966 | | ADS78291 | 0 | | | 0 | 2.6.1.62 | 1383 | 460 | 1383 | 460 | 100 | 100 |
| 937, 938 | | | | Silicibacter sp. TM1040 | | ADF03944 | 9.00E-69 | | | 2.6 | 2.6.1.21 | 855 | 284 | 2000 | 298 | 48 | 95 |
| 939, 940 | | | | Rhodopseudomonas palustris CGA009 | | ADF03944 | 1.00E-53 | | | 0.67 | 2.6.1.21 | 855 | 284 | 86941 | 298 | 39 | 100 |
| 941, 942 | | | | Xanthobacter autotrophicus Py2 | | ADF03944 | 8.00E-55 | | | 2.7 | 2.6.1.21 | 879 | 292 | 2840 | 298 | 41 | 100 |
| 943, 944 | | | | Azoarcus sp. BH72 | | AEM18040 | 8.00E-53 | | | 0.17 | 2.6.1.21 | 870 | 289 | 1899 | 283 | 40 | 100 |
| 945, 946 | | | | Clostridium beijerinckii NCIMB 8052 | | AEM18031 | 2.00E-46 | | | 0.011 | 2.6.1.21 | 855 | 284 | 636 | 283 | 39 | 100 |
| 947, 948 | | | | Alcanivorax borkumensis SK2 | | AAY13560 | 2.00E-54 | | | 0.042 | 2.6.1.21 | 837 | 278 | 897 | 282 | 40 | |
| 951, 952 | aspartate aminotransferase [Pyrococcus horikoshii]. | 14590640 | 2.00E-52 | Pyrococcus horikoshii | Bacterial polypeptide #10001. | ADS41897 | 5.00E-53 | Tumour suppressor gene derived chemically modified sequence #530. | AAS46730 | 3.6 | 2.6.1.1 | 1206 | 401 | 9502 | 387 | 91 | |

APPENDIX 1-continued

| SEQ ID NO: | NR Description | NR Accession Code | NR Evalue | NR Organism | Geneseq Protein Description | Geneseq Protein Accession Code | Evalue | Geneseq DNA Description | Geneseq DNA Accession Code | Evalue | Predicted EC Number | Query DNA Length | Query Protein Length | Subject DNA Length | Subject Protein Length | % ID Protein | % ID DNA |
|---|---|---|---|---|---|---|---|---|---|---|---|---|---|---|---|---|---|
| 953, 954 | aspartate aminotransferase [*Aquifex aeolicus*] | 15606968 | 0 | *Aquifex aeolicus* | Bacterial polypeptide #10001. | ADN17496 | 0 | Bacterial polypeptide #10001. | ADS45406 | 0 | 2.6.1.1 | 1185 | 394 | 0 | 394 | 100 | |
| 955, 956 | conserved hypothetical protein [*Aspergillus terreus* NIH2624] | 115385557 | 1.00E-126 | *Aspergillus terreus* NIH2624 | Amino-transferase/mutase/deaminase enzyme #14. | ADS78245 | 1.00E-170 | Amino-transferase/mutase/deaminase enzyme #14. | ADS78244 | 0 | 2.6.1.42 | 879 | 292 | 954 | 317 | | |
| 957, 958 | hypothetical protein OG2516J_5919 [*Oceanicola granulosus* HTCC2516] gi|89043511|gb|EAR49723.1| hypothetical protein OG2516J_5919 [*Oceanicola granulosus* HTCC2516] | 89070918 | 0 | *Oceanicola granulosus* HTCC2516 | Amino-transferase/mutase/deaminase enzyme #14. | ADS78325 | 0 | Amino-transferase/mutase/deaminase enzyme #14. | ADS78324 | 0 | 2.6.1.62 | 1366 | 461 | 0 | 460 | 72 | |
| 959, 960 | aminotransferase; class III [*Aeromonas hydrophila* subsp. *hydrophila* ATCC 7966] | 117619456 | 1.00E-158 | *Aeromonas hydrophila* subsp. *hydrophila* ATCC 7966 | Amino-transferase/mutase/deaminase enzyme #14. | ADS78291 | 0 | Amino-transferase/mutase/deaminase enzyme #14. | ADS78290 | 0 | 2.6.1.62 | 1383 | 460 | 1383 | 460 | | |

SEQUENCE LISTING (1125 sequences)

SEQ ID NO: 1 - DNA, 879 bp, Unknown
  Obtained from environmental sample
gtggcgtgggtcgatggcgaactcgttccgcttcacgaggcccgcattccgcttcttgatcagggtttcctgcattccgatctgacctatgacgtacccgccgtttgggatggcaggtttttccgccttgatgatcacctcgatcgatttgaggtgagctgcgcgaaactgaagctgaaaagcccgatggatcgcgaaaccatgaaggcaacacttgtcgagatggtggcgaaaagcggcatccgtgatgcctatgtggaaatgatcgtcacacgaggtctgaaattcgtgcgcggcaacaaacccgaagacatcgtgaattcgctttacatgctggtcatgccctatgtgtgggtgatgtcaccggaaatacagcgtgttggcggcagtgcggtgatcacccgcacggtgcgtcgtgttcccccgggcgccatcgacccgacgatcaagaacctgcaatggggtgatttcgtgcgcggtctgatggaagcgcaggatcgcggtgccatttacccgatccttcccgatggtgacggcaacatcaccgaaggctccggcttcaatgtgttcctggtcaagaatggcgtgctttacacaccggaccgtggcgttctggaaggtgtgacacgaaagaccgtgttcgatatcgccgccgtcaagggctggaaggttgcccttgaacatgtgccggttgaacttgcctatcatgccgacgaaatctttttctgcacgacggcaggcggcatcatgccggtcacgacgctggatggagaacttgttggcggcggacaggttggcccggtcactcgcgctatttgggacgaatactggaagctgcattacacagaagatttgagttttgcggtggattatccctga

SEQ ID NO: 2 - protein, 292 aa, Unknown
  Obtained from environmental sample
  DOMAIN (5)...(277): Aminotransferase class IV
  SITE (182)...(185): N-glycosylation site. Prosite id = PS00001
MAWVDGELVPLHEARIPLLDQGFLHSDLTYDVPAVWDGRFFRLDDHLDRFEVSCAKLKLKSPMDRETMKATLVEMVAKSGIRDAYVEMIVTRGLKFVRGNKPEDIVNSLYMLVMPYVWVMSPEIQRVGGSAVITRTVRRVPPGAIDPTIKNLQWGDFVRGLMEAQDRGAIYPILPDGDGNITEGSGFNVFLVKNGVLYTPDRGVLEGVTRKTVFDIAAVKGWKVALEHVPVELAYHADEIFFCTTAGGIMPVTTLDGELVGGGQVGPVTRAIWDEYWKLHYTEDLSFAVDYP

SEQ ID NO: 3 - DNA, 855 bp, Unknown
  Obtained from environmental sample
atgcgtactgtttatgtgaacggccagtatgtgccggaaaatgaagccacgatttcgattttcgaccgttccttcctgtttgccgatggcgtctatgaagtcacctcggttctggatggcaaactgatcgattttaacggccatatgacccgccttgcccgctcgctttcggaacttggctttacctatgttcccgatattgatgaactgcttgcggttcaccgcgaactggtcaaacgcaacaatgtgaccgagggtctggtttatcttcaggtctcgcgcggctcggccggggatcgtgatttcgcgatcaacaaggataccccggcaacgctggttttgttcacgcagtccaaatcactgatcaaatccgcccttgccgaacgcggccagaaaatcctgacctacccggatgtgcgctggcgccggtctgacatcaaaaccgttcagcttctctatgcgtcgcttctcaaaaccgaagccgccgccaaaggggccgatgatgcatggatggtacttgatggttatatcaccgaaggctcgtcaaataacgcctatatcgtgaccaaggacaacgtcatcgtcacccgccagctttccaacgacatcctgcacggcatcacccgcaaggcggttttgaaatgcgccgaggaattgcagcttaaagtcgaagaacgcctgttcacggtcgatgaagtcttaaacgccaaagaagccttctcaacctcggcctcggcctttgtctgcccggtcgccgaagttgacggcaccaaaatcggcgacggcaaacccggcccgatcgccaaacgcctgcgcgagatttacatcgaagccaaccgcgccgctgcgatctaa

SEQ ID NO: 4 - protein, 284 aa, Unknown
  Obtained from environmental sample
  DOMAIN (7)...(276): Aminotransferase class IV
  SITE (83)...(86): N-glycosylation site. Prosite id = PS00001
MRTVYVNGQYVPENEATISIFDRSFLFADGVYEVTSVLDGKLIDFNGHMTRLARSLSELGFTYVPDIDELLAVHRELVKRNNVTEGLVYLQVSRGSAGDRDFAINKDTPATLVLFTQSKSLIKSALAERGQKILTYPDVRWRRSDIKTVQLLYASLLKTEAAAKGADDAWMVLDGYITEGSSNNAYIVTKDNVIVTRQLSNDILHGITRKAVLKCAEELQLKVEERLFTVDEVLNAKEAFSTSASAFVCPVAEVDGTKIGDGKPGPIAKRLREIYIEANRAAAI

SEQ ID NO: 5 - DNA, 855 bp, Unknown
  Obtained from environmental sample
atgtcccgtattgcttatgttaacggtgcttatgttccccacgatgaggctgtggtctcgatcgatgatcgcggctatcagtttgctgatgctgtgtatgaaggtgtgactgtgcgcaaaggccgcatgatagaccttgaaccacacatggacaggctcgcgcgctcgatgcgggagcttgcgatggcagcaccgatggagcgcgcgcccatgcgctttgtgttcagggaggttatccggcgcaaccgtataagcgatggatttctctatatacaaatcagccgcggcgtagcccgacgcgaccatgccttccccaccacacccacggcaccgagccttgttgtaacctgcaaacgcctgagtgttgacggtgtttttgcccgcgcagccaagggtgtgaaggccttttcggaaagtgatatccgctggggtcggtgcgatatcaaatccacgtccctgctcccgaacatcctcgcgaaacaggccgccaaggaaaaaggcggctttgaggccgtgcttgtagaccgggacggttatgtaaccgaaggcagcagcaccaacatgtggatggtacgcaccgacggcacgctggtgacccgctcaacggatgataacattctgcccggcattacccgtgcgacgattaaaaagctggcggaagagttgcagatcaaggtggagacaaaagccttcacgctggaagacgccaaagcaggcgcggagatgttcctctcaagctcgactggctgcgccatgccgattgtggagctggacggccataagattggcgacggaacacccggtcccgtcgccagacgattgattgaagcttaccggacttacatggaggcctga

SEQ ID NO: 6 - protein, 284 aa, Unknown
  Obtained from environmental sample
  DOMAIN (8)...(279): Aminotransferase class IV
MSRIAYVNGAYVPHDEAVVSIDDRGYQFADAVYEGVTVRKGRMIDLEPHMDRLARSMRELAMAAPMERAPMRFVFREVIRRNRISDGFLYIQISRGVARRDHAFPTTPTAPSLVVTCKRLSVDGVFARAAKGVKAFSESDIRWGRCDIKSTSLLPNILAKQAAKEKGGFEAVLVDRDGYVTEGSSTNMWMVRTDGTLVTRSTDDNILPGITRATIKKLAEELQIKVETKAFTLEDAKAGAEMFLSSSTGCAMPIVELDGHKIGDGTPGPVARRLIEAYRTYMEA

SEQ ID NO: 7 - DNA, 870 bp, Unknown
  Obtained from environmental sample
atggtttttctgaacgggcagttcgtcgcgttgggggacgccaaggtctccgtgctcgaccgcggcttcatcttcggcgacggcgtctacgaggtcgtgccggtgtactcgcgcgtgccgttccgcctcgacgagcacctcgtgcgactcgagcgcagtctcgccgcggtcgccatccgcaatccgtacagccgcgccgagtggcgcggcttcatcaccgagctggtggcacgccaggacttcgaggaccagggggtctatttccaggttacgcgcggcgtggccaagcgcgaccatgccttcccgaagaacgccgagccgacggttttcatgatggcaagcccgctcgtcaacccgccgcgcgagcaagtggaaaacggcgcgcccgcggtgagcgcgcgcgacaatcgctggctgcgctgcgacatcaagtcgatctcgctcatcggcaacgtgctgctgcgccagctctcggcgcaagtcgacgcggccgagacgatccttttccgcgatggcaagcttaccgaggcctccgcgtcgaacgtgttcattgtgaagttcggcgtcgtcgccgggccgccgaagagctcactcatcctccccggaatcacctacgacgtgatcgtcgagcttgcgcaggctgccggcatcccgctggagctgcgcgaggtaacggaggccgaggtacgcagcgccgacgagctgtgggtgacctcgtcgtccaaggaagtgctcgccatcgtgcacctcgatggcgcgtcgattggcgacgggcggcccggcccggcgttccgccagatgtaccgcctctaccaggatttcaagcagaaggtcatgcgcgcgggccggcgccagtcggtctcggcctga

SEQ ID NO: 8 - protein, 289 aa, Unknown
  Obtained from environmental sample
  DOMAIN (5)...(272): Aminotransferase class IV
MVFLNGQFVALGDAKVSVLDRGFIFGDGVYEVVPVYSRVPFRLDEHLVRLERSLAAVAIRNPYSRAEWRGFITELVARQDFEDQGVYFQVTRGVAKRDHAFPKNAEPTVFMMASPLVNPPREQVENGAPAVSARDNRWLRCDIKSISLIGNVLLRQLSAQVDAAETILFRDGKLTEASASNVFIVKFGVVAGPPKSSLILPGITYDVIVELAQAAGIPLELREVTEAEVRSADELWVTSSSKEVLAIVHLDGASIGDGRPGPAFRQMYRLYQDFKQKVMRAGRRQSVSA

SEQ ID NO: 9 - DNA, 432 bp, Unknown
  Obtained from environmental sample
atgagcatcgtctatctgaacggccgctatcttccgatcgaggaagccaccgtatccgtgctcgatcgcggcttcatctacggcgacggcgtctacgaactggtgcccgtctacggccggacgccgtaccgcatgccgcagcacctgtcgcggctccagcacagcctcgaccgcatccgcctcgccaatccgcactcggacgccgagtgggagagcatcatcggcgggctgatcgagcgccaggagttcgacaaccagggcgtatacctgcaggtcacgcgcggcgtcgccaagcgcgaccacacgttccccaaaggcgtccccgcgaccgtgttcatgatgagcaatccgctcgccacgccgtcggccgacgtcgtcgcgcgcggcgtcgcatgcgtgaccgcgatcgacgagcgctggcgcaattctttg

SEQ ID NO: 10 - protein, 144 aa, Unknown
  Obtained from environmental sample
MSIVYLNGRYLPIEEATVSVLDRGFIYGDGVYELVPVYGRTPYRMPQHLSRLQHSLDRIRLANPHSDAEWESIIGGLIERQEFDNQGVYLQVTRGVAKRDHTFPKGVPATVFMMSNPLATPSADVVARGVACVTAIDERWRNSL

SEQ ID NO: 11 - DNA, 879 bp, Unknown
  Obtained from environmental sample
atggttcgtacggtctatgtaaacggatattatgcgccgtatgagcatgccgtcgtgcatgtcgaggatcggggctatcaattcgcagatgccgcctatgaggtttgcgaagtacgcggcggagcgctgatcgacgagcgcctgcatatggaacggctgcgccggtcgctgggcgagctcagaattgattttcccatgaccatgcgctccctcagcgtgatcctgcacgagacggtgcgccggaaccgggtccgcgacggctccgtctatctccaggtaagccgcggcgtcgccccgcgcgactttgccttcccggacccatccgcgaggccgagcgtggtctgctatgccaaggcgaagccggctgccgcattggagcgccgggcggccaagggcatccgcgtcgtcaccatgccggatatccgctggcgccggccggacatcaaatcggtctcgctgctgcccaatgtgctggcgcggcaggcagcccacgatgtcggagccgacgaagcctggctggtcgacgacaacggctttgtcaccgaaggcgccgcctgcaacgcctggatcctgatcgaggacgatacgctcgtcacccggccggccgaaatggccattttgcgcggcgtcacccgcaccgttctgctgcaggcaattgccgaggcacagctcaaggttgttgagcggccgttcagcgtcgaagaggcaaaaagggccaaggaggccttcataacgtcggcaacgtcgatcataacgccggtgatcgcgataaacggtgtgcccctgggcgacggcaagcccggaccggtagcaatgaagctgcgccggctcttccggggctcggccgagaaatcaggagccggaacgttgttggaatag

SEQ ID NO: 12 - protein, 292 aa, Unknown
  Obtained from environmental sample
  DOMAIN (8)...(279): Aminotransferase class IV
MVRTVYVNGYYAPYEHAVVHVEDRGYQFADAAYEVCEVRGGALIDERLHMERLRRSLGELRIDFPMTMRSLSVILHETVRRNRVRDGSVYLQVSRGVAPRDFAFPDPSARPSVVCYAKAKPAAALERRAAKGIRVVTMPDIRWRRPDIKSVSLLPNVLARQAAHDVGADEAWLVDDNGFVTEGAACNAWILIEDDTLVTRPAEMAILRGVTRTVLLQAIAEAQLKVVERPFSVEEAKRAKEAFITSATSIITPVIAINGVPLGDGKPGPVAMKLRRLFRGSAEKSGAGTLLE

SEQ ID NO: 13 - DNA, 852 bp, Unknown
  Obtained from environmental sample
atgaacgcactaggatattacaacggaaaatggggtcctcttgacgaaatgaccgtgccgatgaacgacaggggctgcttctttggagacggcgtgtacgacgctacctgcgccgctaacggggtgatttttgccctggatgagcacattgacaggtttttcaacagcgcaaaactcctggaaatagaaatcggttttacaaaagaggaactgaaaaaaaccatcaatgaaatgtactccaaagtggataagggggagtaccaggtttattggcaggcgactcgtggaaccggccggcgaagccatgtatttccggcaggtccctcaaatctctggataatgattaagcctaatcacgtcgacgatctttatagaaaaataaagctcattaccacggaagatacccgctttttccactgcaacatcaaaacacttaaccttattcccaatgtcattgcttcccagcgagcgctggaagcgggctgccacgaggcagtttttcaccggggcgaaacagtgaccgaatgcgcccatagcaatgtccacataattaaggacggcaggtttattactcatcaaactgacaacctgatcctccctggcatagcccgcagccatttgttgcaagcctgcgacaggctgaatgttccggttgacgaacgggaatttaccctttcggaattgttcggcgcggatgaggtacttgtgtccagcagcggcacactcggtcttagcgccgatacaatagacggaaaaaatgtgggagggaaagcgccggaactgctaaaaagaattcaggacgaagtgttgaaggaatttatcgaagcgacagctcgtgccgaattctttgga

SEQ ID NO: 14 - protein, 284 aa, Unknown
  Obtained from environmental sample
  DOMAIN (8)...(270): Aminotransferase class IV
MNALGYYNGKWGPLDEMTVPMNDRGCFFGDGVYDATCAANGVIFALDEHIDRFFNSAKLLEIEIGFTKEELKKTINEMYSKVDKGEYQVYWQATRGTGRRSHVFPAGPSNLWIMIKPNHVDDLYRKIKLITTEDTRFFHCNIKTLNLIPNVIASQRALEAGCHEAVFHRGETVTECAHSNVHIIKDGRFITHQTDNLILPGIARSHLLQACDRLNVPVDEREFTLSELFGADEVLVSSSGTLGLSADTIDGKNVGGKAPELLKRIQDEVLKEFIEATARAEFFG

SEQ ID NO: 15 - DNA, 837 bp, Unknown
  Obtained from environmental sample
atgagagaaattgtttttttgaatggggaatttcttgaaaaagaagcggctaaaatttctcccaatgataggggttttatttttgccgatggtgtttacgaagttgccaaatattacaatggacgcccttttcggtatgatgaccacttaaaaaggctggaacgcagtctttctgaacttgaaattgaatacccggatattgaaaatcttcaatcggtttttaactcactcataaccagaaataatcttaatgataaacacgcaggggtatatttgcaaattacacgcggagaacataaacgtgtgcatcatttccctgaaaatgttcagccaactgtttatgcttttgctttcgaattgccttccttcaaggaaaatcttgagaaaggaatcaaagtaattactcacgaagatattcgctggcaacgttgtgatattaaatcggtttcactgcttcccaatacaatgctgtataacaaagccgtaaatgccggggcgggagagtgcgttttaattcgcaatggaatggttaccgaagctacacattcaagcgttttgtgtgtaaaagacggaattgttattacacgaccactatcaaatctgattcttcccggaattacaagaaaagttgtacaggagatatgctctgtccataatattgcttttgaagagcgcgaattttctgaaactgaattgcttgaaatggatgaaattataattgctggtacggggagcgaaataactccggcaatacaagtaaacgaaacaacgattggaaatggctcaccaggcaaaatcacacggtttattcagcaaaagttttttgagatggtttaa

SEQ ID NO: 16 - protein, 278 aa, Unknown
  Obtained from environmental sample
  DOMAIN (8)...(275): Aminotransferase class IV
  SITE (1)...(4): Tubulin-beta mRNA autoregulation signal. Prosite id = PS00228
  SITE (257)...(260): N-glycosylation site. Prosite id = PS00001
MREIVFLNGEFLEKEAAKISPNDRGFIFADGVYEVAKYYNGRPFRYDDHLKRLERSLSELEIEYPDIENLQSVFNSLITRNNLNDKHAGVYLQITRGEHKRVHHFPENVQPTVYAFAFELPSFKENLEKGIKVITHEDIRWQRCDIKSVSLLPNTMLYNKAVNAGAGECVLIRNGMVTEATHSSVLCVKDGIVITRPLSNLILPGITRKVVQEICSVHNIAFEEREFSETELLEMDEIIIAGTGSEITPAIQVNETTIGNGSPGKITRFIQQKFFEMV

SEQ ID NO: 17 - DNA, 918 bp, Unknown
  Obtained from environmental sample
atgttggatgaacggatggtgttcattaacggcgactttgtaaagtggcaggacgcaacggtccacatgatgagccacagcttcgcgcgcggctcggccattttcgaagtcatcagcttttacgcgacgggctcgggtccggctgttttccggctggacgatcacatcgcgcgtttggaaaaatcggcaagcttcctgggcatggagcttcccctgagccacgaggcactgtgccgggccgtggcggacaccgtgcgccgcaaccgcctcggtcggggcgtcatcaaggtgatcggctactacccccagttcgcgctcgacattcagccgccgcagaagcgtctggatgttgcggtctttgcgctggagccggcgcaggacctgaaggactttgagttttcctttgaaaagggcaccagtgcaggcatcgcgcgctggcgcaaactcgaccccgagacggtccccatcgaggccaaggccgccgccaactacctgaacgggatgatcgccagccaggatgtccggaaacgagggttcgaggatgccatcctgctggacacccagggattcatcgccgagggcgccaccgaatccgtttttctggtcaaagacggcaagctgctgacgccctgcctggggaccgtgctcgacagcatcacccgccggtccattttgcaggtcgcgcgccatctcgggatcgaaacgatcgaaggccgtctgcggccggcgctgctcttcgaagccgatgaggtctttttcgccaacacccccttcaaggtgatccccgtccgtcgcatcgaggagcgccggatgtcggccactcccggcccgatgcagcgcaggttgtgggatgttttgcagaagatcgccgccggccaagagcctgacttcgccgagtggctctatgccgtggactga

SEQ ID NO: 18 - protein, 305 aa, Unknown
  Obtained from environmental sample
  DOMAIN (10)...(287): Aminotransferase class IV
MLDERMVFINGDFVKWQDATVHMMSHSFARGSAIFEVISFYATGSGPAVFRLDDHIARLEKSASFLGMELPLSHEALCRAVADTVRRNRLGRGVIKVIGYYPQFALDIQPPQKRLDVAVFALEPAQDLKDFEFSFEKGTSAGIARWRKLDPETVPIEAKAAANYLNGMIASQDVRKRGFEDAILLDTQGFIAEGATESVFLVKDGKLLTPCLGTVLDSITRRSILQVARHLGIETIEGRLRPALLFEADEVFFANTPFKVIPVRRIEERRMSATPGPMQRRLWDVLQKIAAGQEPDFAEWLYAVD

SEQ ID NO: 19 - DNA, 861 bp, Unknown
  Obtained from environmental sample
atggacgcgctgggctattacaacggaaaatgggggcctctggacgagatgaccgtaccgatgaacgacaggggctgttactttggggacggcgtgtacgatgctgcctgcgccgccaacggaacgatctttgccccggatgagcatattgaccggtttttcagcggcgcaaagctcctggaaataagaatcaccttaacaaaagaggaacttaaaaaaacccttaacgagatgctctgtaaagtagacaagggggagtacctggtttattggcaggcgactcgcggaacaggccgtcgaagccatgtgtttccggcaggcccctcaaatctctggattatgataaagccccaccccatcgacgatctttacaaaaaaataaagctcattaccatggaagacacccgctttcttcactgcaacatcaagacccttaaccttattcccaatgtcattgcctcccagcgggcgctggaagcgggctgctacgaaacggtatttcaccggggcgaaacagtaaccgagtgtgcccacgacaatgtccacatcatcaaaagcggcaggtttatcacccatccggtagacaacctaatcctccggggcatagcccgcagtcatttgttgcaagcttgcgacaggctgaacattccggttgaagaacgggaatttagcctgtcggagttgtttgacgcggacgaggtgcttgtgtccagttgcggcagtttcggtcttagcgccgatgcaattgacggaaaagacgtgggaggaaaagcgccggaactgcttaaaaaaattcaggacgaggtgcttagggaatttgtcgaagcgacaggctacgcgcccgcctggagcagggtgtag

SEQ ID NO: 20 - protein, 286 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFAPDEHIDRFFSGAKLLEIRITLTKEELKKTLNEMLCKVDKGEYLVYWQATRGTGRRSHVFPAGPSNLWIMIKPHPIDDLYKKIKLITMEDTRFLHCNIKTLNLIPNVIASQRALEAGCYETVFHRGETVTECAHDNVHIIKSGRFITHPVDNLILRGIARSHLLQACDRLNIPVEEREFSLSELFDADEVLVSSCGSFGLSADAIDGKDVGGKAPELLKKIQDEVLREFVEATGYAPAWSRV

SEQ ID NO: 21 - DNA, 861 bp, Unknown
  Obtained from environmental sample
atggacgcactgggatattacaacggaaaatggggccctctggacgagatgaccgtgccgatgaacgacaggggctgctactttggagacggagtatacgacgccaccatcgccgctaatggggtgatctttgccctggacgagcacattgacaggtttttcaacagctcgaagcttctggaaataaaaatctgtataacaaaagaggaacttaaaaaaacacttaatgatatgcacttcaaagtggataaaggggtgtacatggtttattggcaggcgactcgcggaacaggccgacgaaaccatgtatttccggcaggtccttcaaatctctggataatgataaagcccaatcacatagacgatcttaataaaaaaataaagctcattaccacggaagatacccgcttcctccactgcaatatcaagacccttaaccttattcccaatgtcattgcctcccagcgggcgctggaagcgggctgccaggaagcggtttttcaccggggcgaaacggtaaccgagtgcgcccacagcaatgtccatataatcaagaacggcaggtttatcacccatcaggcggacaacctgatcctccggggcatagcccgcagccatttgttgcaagcctgcgacaggctgaacgttccggttgacgaacgggaattcaccctcccggaattatttgacgctgacgaggtgcttgtgtccagtagtggcacattcggccttagcgccgatacaatcgacgggaaaagcgtgggaggaaaagcgccggaactgcttaaaaaaattcaggacgaagtaatgagggaatttatcgaagcaacaggctacacgcctgagtggagaaaggcatag

SEQ ID NO: 22 - protein, 286 aa, Unknown
  Obtained from environmental sample
  DOMAIN (8)...(270): Aminotransferase class IV
  SITE (55)...(58): N-glycosylation site. Prosite id = PS00001
MDALGYYNGKWGPLDEMTVPMNDRGCYFGDGVYDATIAANGVIFALDEHIDRFFNSSKLLEIKICITKEELKKTLNDMHFKVDKGVYMVYWQATRGTGRRNHVFPAGPSNLWIMIKPNHIDDLNKKIKLITTEDTRFLHCNIKTLNLIPNVIASQRALEAGCQEAVFHRGETVTECAHSNVHIIKNGRFITHQADNLILRGIARSHLLQACDRLNVPVDEREFTLPELFDADEVLVSSSGTFGLSADTIDGKSVGGKAPELLKKIQDEVMREFIEATGYTPEWRKA

SEQ ID NO: 23 - DNA, 861 bp, Unknown
  Obtained from environmental sample
atggacgcactgggatattacaacggaaaatgggggcctctggacgagatgaccgtgccgatgaacgacaggggttgtttctttggggacggagtgtacgacgctaccatcgccgctaacggagtgatctttgccctggacgagcacattgaccggtttttaaacagcgcaaagctcctggaaatagaaatcggttttacaaaagaggaattaaaaaaaactttttttgaaatgcactccaaagtggataaaggggtgtacatggtttattggcaggcgactcgcggaacaggccgtcgaagccatgtatttccggcaggtccctcaaatctctggattatgattaagcccaatcacgtcgacgatctttatagaaaaatcaagctcattaccatggaagatacccgcttcctccactgcaacatcaagacccttaaccttattcccaatgtcattgcctcccagcgggcgctggaagcgggctgccacgaggcggtctttcaccggggtgaaacagtaaccgagtgcgcccacagcaatgtccacatcattaaaaacggcaggtttatcacccaccaggcggacaacctaatccttcggggcatagcccgtagccatttattgcaagcctgtatcaggctgaacattccatttgacgaacgggaatttaccctttcggaattatttgacgcggatgagattcttgtgtccagcagcggcacactcggccttagcgccaatacaattgatggaaaaaacgtggggggaaaagcgccggaactgctaaaaaaaattcagggcgaagtgttgagggaatttatcgaagcgacaggctacacgcctgagtggagcacagtatag

SEQ ID NO: 24 - protein, 286 aa, Unknown
  Obtained from environmental sample
  DOMAIN (8)...(270): Aminotransferase class IV
MDALGYYNGKWGPLDEMTVPMNDRGCFFGDGVYDATIAANGVIFALDEHIDRFLNSAKLLEIEIGFTKEELKKTFFEMHSKVDKGVYMVYWQATRGTGRRSHVFPAGPSNLWIMIKPNHVDDLYRKIKLITMEDTRFLHCNIKTLNLIPNVIASQRALEAGCHEAVFHRGETVTECAHSNVHIIKNGRFITHQADNLILRGIARSHLLQACIRLNIPFDEREFTLSELFDADEILVSSSGTLGLSANTIDGKNVGGKAPELLKKIQGEVLREFIEATGYTPEWSTV

SEQ ID NO: 25 - DNA, 840 bp, Unknown
  Obtained from environmental sample
atgcagaaggtttttttaaacggtgaatacctgcccttgccggaagccaaggtttcggttctggatcgcggttttttgtttggcgatggcgtttacgaagttattccggtctatgcggggcatttattcaggatggccgaccatatcgagcggttgaacaatagcctggcgggtatacgtctgcctttggattatagcgtcgacgactggcgggcgatttttgcgcctttgttggacggcggcaaggatcaatatatctatttacaaattacccgcggctatgcgccgaaacgcgatcacgcttttcctgaacaagtcataccgactatttttgccatgtgttcggatattacgcctttcccggaaaaatttaccggcatcaaagccgtctccgtggacgatatccgctggcaactatgccatatcaaggccattaccttgctggccaacattctgttgcggcaacaggccgtcgagcagggcggtgccgaggctattctggtaaaaaacggctatgttatcgaaggagctgcgagtaacgtttttaccgtgatcgatggggtattgattaccccgccaaagtcgaatgagattctgcccggtatcacccgcgatgttgtcctgaagctggcgcaagcccatggcttgccgttccgggaagatattatcgccttggaagcgttacgctccgccgacgaaatttgggtcgccagttccatccgggaaattctgccggtcgtggaattggacggagtagccgtagccggcggcaaacccggagcgatatggcgcgacatggataactatttgcaagcctataagaaatcctgtcatgactga

SEQ ID NO: 26 - protein, 279 aa, Unknown
  Obtained from environmental sample
  DOMAIN (7)...(271): Aminotransferase class IV
  SITE (53)...(56): N-glycosylation site. Prosite id = PS00001
MQKVFLNGEYLPLPEAKVSVLDRGFLFGDGVYEVIPVYAGHLFRMADHIERLNNSLAGIRLPLDYSVDDWRAIFAPLLDGGKDQYIYLQITRGYAPKRDHAFPEQVIPTIFAMCSDITPFPEKFTGIKAVSVDDIRWQLCHIKAITLLANILLRQQAVEQGGAEAILVKNGYVIEGAASNVFTVIDGVLITPPKSNEILPGITRDVVLKLAQAHGLPFREDIIALEALRSADEIWVASSIREILPVVELDGVAVAGGKPGAIWRDMDNYLQAYKKSCHD

SEQ ID NO: 27 - DNA, 801 bp, Unknown
  Obtained from environmental sample
atgggtgcaagcgagacgctggcgtcgatcgacggccagatcgtgccgctcgatcaggcgacgatcctgatcaccgatcagggcctgatccgtggcgacggggcgttcgaagtcgtgcggctcttcgacggtgtgccgttcgcgctggaccagcatttcgagcgcctgcaacgctccgccgaaaacctgctgctcccagtggacgtggagctggtgcacagcgaggcgctggcgctgctggcggccagtaacgccgcgggtgtggagcatcagctgatgcggatcatgctgacccgtggcgggcgacggatcgtgctgaccgagccgatgccgttcgagcccgaggaggcgcgcctgaagacgatcacctaccagccgaccctcgtgctggacggcgtcaagtcgctctcgtatgccgcgaacatgctcgccacccggcgggcggtggcggcgggctacgacgaggcgctgctggtgacgcccgcgggccgggtgctggaagccccgaccgcgtcgctgttctgggtgaagaacggtgagctgcgcacgccgccgctgagcgatcacatcctcgcctcgatcacccgcggcctgctgctggagctcacctccgcggtcgagtacccgacggcgctcccggagctgctcgaggcggatgaggtgttcctcgcctcgaccacccgtgaggtccagccggtctgcgagatcgacgggcgccgcttcctcaccggcggcccggtcgcgagcgcgaccgatcagacggtccaggcccacctcgcggagctgctcgcgcgggcgtga

SEQ ID NO: 28 - protein, 266 aa, Unknown
  Obtained from environmental sample
  DOMAIN (11)...(256): Aminotransferase class IV
MGASETLASIDGQIVPLDQATILITDQGLIRGDGAFEVVRLFDGVPFALDQHFERLQRSAENLLLPVDVELVHSEALALLAASNAAGVEHQLMRIMLTRGGRRIVLTEPMPFEPEEARLKTITYQPTLVLDGVKSLSYAANMLATRRAVAAGYDEALLVTPAGRVLEAPTASLFWVKNGELRTPPLSDHILASITRGLLLELTSAVEYPTALPELLEADEVFLASTTREVQPVCEIDGRRFLTGGPVASATDQTVQAHLAELLARA

SEQ ID NO: 29 - DNA, 849 bp, Unknown
  Obtained from environmental sample
atgaaagagctgggctattacaacggaaaaatcggggaattaagcgaaatgaccgtgcccatgaatgaccgggcctgctggtttggggacggggtctatgaggccggcatgtgccgggatgggcagatcttcgccctggatgagcatgtggatcggctctttcgcagcgcggccatgctggaaatccgggttcccgtttccaaagaggagctgaagcagctgttatatgatcttatcggaaagatggataccggcgatctcctggtgtattatcaggtcacccggggctgcggtccccggggccacgccttccccgatggtcccgccagcctgtgggtcaccctgcggccgaaaaccctgaatccctttctgcctcccgtctccctgatcacggatccggatacccgctttttccattgcaatatcaagaccctgaacctgatcccctcggtcatggcgaatgagaaggccaggcgggccggctgttacgagtgcgtgctgtatcggcccggcggccgggtcacggaatgctcccacagcaatgtgcatatcatccgggacggcgtcttcatcaccgccccgacggatgagctcatcctgcctgggatcgcccgggcccatctgatcagggcttgttccgcgctggggatccccgtccgggaaactcccttcaccgtggaggatctgaaagccgccgacgagatcctgacctccagctccaccgcgccctgcatccgcgcctgccgggtcgacgggcaggcagccggtatgcggcggccggatctgtttgatgcgctgcatcgggcggtttttgatgagtattttggaaatcaggggtggaggtcatga

SEQ ID NO: 30 - protein, 282 aa, Unknown
  Obtained from environmental sample
  DOMAIN (8)...(271): Aminotransferase class IV
MKELGYYNGKIGELSEMTVPMNDRACWFGDGVYEAGMCRDGQIFALDEHVDRLFRSAAMLEIRVPVSKEELKQLLYDLIGKMDTGDLLVYYQVTRGCGPRGHAFPDGPASLWVTLRPKTLNPFLPPVSLITDPDTRFFHCNIKTLNLIPSVMANEKARRAGCYECVLYRPGGRVTECSHSNVHIIRDGVFITAPTDELILPGIARAHLIRACSALGIPVRETPFTVEDLKAADEILTSSSTAPCIRACRVDGQAAGMRRPDLFDALHRAVFDEYFGNQGWRS

SEQ ID NO: 31 - DNA, 1062 bp, Unknown
  Obtained from environmental sample
atgaaaaacaaactaactaaaccatacgcaatcgaaccacgctgttcgattgatcttaccctaagcgaaaatcccttggggtgttcgcctatggttaccaacaaaatccgtaaggacacatcacaatgtgtccctatcccaaaccgttacccatcatcaaatggcaatctgttaaaaaagaagttagccgatgcatttggtggagaatcaaacaactttttcataactaacggttcggaaaatatcattctaaatattcccagaatcttggctaaacccggagatggtgtggtaatccccgaattatcatttccattgtttgcactttattgtggatttgccggattgagtattcagcttgtaccgatgaaaaatgatctaggaattgatttggcgaaatgtaaggatgtcgcattgcaacgtcctttccctcgcctcgtcttcatctgcaatcctaataatcccaccggtatgcttttaaaacgatctgacattctggaatttttggataaaatcccagaagatatcatcgccatcatcgacgaagccaacattgattttggtggtgagagcgtgatcgaccaagccttcattcgcccaaatgtattggtgctgagaactttttccaaagggttcggattggctggtatgcgtgttggctttgcagttggcgataaggaattgattcgaaagttaactgagcaaactcccccatttccaattacgagcttgagtgagcaactggcaatcacagcactgcgtgacttagaattcgtggaacagtcaagacagtacatgactagacagagagaaattattaaatccaaactcaaaaatcttgggtgtactgttttcaactctcaagcgaataatatatttgcgaaactaccagacaggatcaatccagaccaattttttaaaaaactgaaccaaaatgatgtctcggtagtcaaaggtagcaaatttacaggttttgacgattcgtattttagaatcagtccgagagatgagaagactaatcaacgatttattaaaattatagagaaagtattaattgtgtag

SEQ ID NO: 32 - protein, 353 aa, Unknown
  Obtained from environmental sample
  DOMAIN (14)...(347): Aminotransferase class I and II
  SITE (78)...(81): N-glycosylation site. Prosite id = PS00001
  SITE (210)...(219): Aminotransferases class-II pyridoxal-phosphate attachment site. Prosite id = PS00599
MKNKLTKPYAIEPRCSIDLTLSENPLGCSPMVTNKIRKDTSQCVPIPNRYPSSNGNLLKKKLADAFGGESNNFFITNGSENIILNIPRILAKPGDGVVIPELSFPLFALYCGFAGLSIQLVPMKNDLGIDLAKCKDVALQRPFPRLVFICNPNNPTGMLLKRSDILEFLDKIPEDIIAIIDEANIDFGGESVIDQAFIRPNVLVLRTFSKGFGLAGMRVGFAVGDKELIRKLTEQTPPFPITSLSEQLAITALRDLEFVEQSRQYMTRQREIIKSKLKNLGCTVFNSQANNIFAKLPDRINPDQFFKKLNQNDVSVVKGSKFTGFDDSYFRISPRDEKTNQRFIKIIEKVLIV

SEQ ID NO: 33 - DNA, 852 bp, Unknown
  Obtained from environmental sample
atggcaaagattttatggaatgatcaaatcgtagaagaaaaagaagtgaaaattggttttgaagaccgtgggtatcaatttggtgatggagtatatgaagtagtcaaaatttataatggtgatttgtttacggcaaaggaacatatagatcgcctgtatgcaagtgctgacaaaattcaaatagtcataccctttacaaaagataagctacatcaattaatgcacgaattaattgaaacgaacgaggttaagaacggtcagatttatttacagatcacacgaggggacagtccacgagttcataacttccctaatccagcagtgaactctgtactaaccgcttatactaaagaaacaaaacgtccactggcacagcaggaaagtggtatcaaagcttgttttgtagaggatattcgatggttaagatgtgatataaaatcactaaacctacttggtaacgtgcttgcaaaacaagaagcagttactaaaggttgctttgaagccattttacatcgtggggaaactattacagaaggttcttcctctaatatgtacggcattaaagatggtgttttgtatacacatccgattagtaacctaattttaaatggtattactagaaaagtgctgttagattgctgtgaggaaataggacttaaggtagttgaagaggcgtttacgaaagaagaggcgctaaacatggacgaatttatcatgtcatcaactagcgctgaggtaatgccggttatatccatcgatgggaatgttattggggacggaaaacctggagagtttacaagaaagcttcagaaagcctttgaacaaaaaattccatccactttaaatgtatga

SEQ ID NO: 34 - protein, 283 aa, Unknown
  Obtained from environmental sample
  DOMAIN (7)...(274): Aminotransferase class IV
MAKILWNDQIVEEKEVKIGFEDRGYQFGDGVYEVVKIYNGDLFTAKEHIDRLYASADKIQIVIPFTKDKLHQLMHELIETNEVKNGQIYLQITRGDSPRVHNFPNPAVNSVLTAYTKETKRPLAQQESGIKACFVEDIRWLRCDIKSLNLLGNVLAKQEAVTKGCFEAILHRGETITEGSSSNMYGIKDGVLYTHPISNLILNGITRKVLLDCCEEIGLKVVEEAFTKEEALNMDEFIMSSTSAEVMPVISIDGNVIGDGKPGEFTRKLQKAFEQKIPSTLNV

SEQ ID NO: 35 - DNA, 1143 bp, Unknown
  Obtained from environmental sample
atgagcgaagaagcctccgcgcagctgtacgctagccttggcgtgcggcccgtgatcaatgctgccggcgcttacacgattttgggcggctcggcgccggccccagccgtgctccaggcgatggaggaagcgaaccgctacttcgtcgagatgcgcgacctcctggcggcgagcggcaagctcatcgccagcatgctcgagtgcgaggcggcctacgtcacgtccggcgctgctggcgccctcgccctctccgccgccgcctgcatgaccggcacggacttcgagaagatcgagcagctgccggacaccacagggatgaagaatgaaatcctcgtccagacgttgctgcgcaccaagtacgaccgctgcgtgacgatcccgggcgcccgcctggtgccggtcggcgacgagaacggcacgacggccgatcagctgcgggcggcgataagcgagcgcacagccgcggtgcacttcctcgcacccggcggccagcgaggcgtcctgccaattaagcaggtaatcgagatcgcccatgcggcgggagtgccggtcatcgtcgacgccgctggccagacctacccgctcgataatctcaagaagtacacacggatgggcgccgacctcgtatgctacgcagcgaagtacttcgacgcgccccattcgactggcatgatcctgggacgttccgacctcatagaggccgccgcgctcaacagcttcatcggtttcgagaccacgggccacctctcgtttggccgggcgatgaaaatcgaccggcaggagatcatcggcctcgtcgtcgctctgcgcgaatggctggcgatgaatcatgaggagcgcttcctgcgctacggagaacgcgcggaacggatcctgggtgcgatcaagggggtgccgggcatcgaggcctaccgcatctcggagcgagaaacgccaccaccggtcgtccgcgaaggcgtcaggatcaaccttctgcctggtttcgggcgttccgcagccgcgattgcgtccgaccttaaggacggctcgccgagcatctgggtcggatttggcgaaagcagcctcaatgtatcggtcgcgttcttccaagatgaggatgcggaaatcgtcgcgcgacggctgcgcgaggcgcttggcgcctga

SEQ ID NO: 36 - protein, 380 aa, Unknown
  Obtained from environmental sample
  DOMAIN (18)...(360): L-seryl-tRNA selenium transferase
  SITE (140)...(143): N-glycosylation site. Prosite id = PS00001
  SITE (361)...(364): N-glycosylation site. Prosite id = PS00001
MSEEASAQLYASLGVRPVINAAGAYTILGGSAPAPAVLQAMEEANRYFVEMRDLLAASGKLIASMLECEAAYVTSGAAGALALSAAACMTGTDFEKIEQLPDTTGMKNEILVQTLLRTKYDRCVTIPGARLVPVGDENGTTADQLRAAISERTAAVHFLAPGGQRGVLPIKQVIEIAHAAGVPVIVDAAGQTYPLDNLKKYTRMGADLVCYAAKYFDAPHSTGMILGRSDLIEAAALNSFIGFETTGHLSFGRAMKIDRQEIIGLVVALREWLAMNHEERFLRYGERAERILGAIKGVPGIEAYRISERETPPPVVREGVRINLLPGFGRSAAAIASDLKDGSPSIWVGFGESSLNVSVAFFQDEDAEIVARRLREALGA

SEQ ID NO: 37 - DNA, 1389 bp, Unknown
  Obtained from environmental sample
atgagcacccccccaaccaattcggcgatcatcacggactacaaggcgcggacccaggggtcgggtgcgctgtttgagcgcgcccgcaaggtgctgccgagcggcatcacgcacgatgcgcgctacctcgacccctattcgatccacgtcgccaaggccaaggggccacgcaagtgggacgtcgatggcaacgagtatgtggattacttcggcggccacggcgccatgctgctcggccattcgcaccccgccgtcgtcgaggcggtgaagaaacagatcgagctgggcacccattacggctcgagccacgagctcgaggtgcgctgggccgagctggtgtgcgagctgacgccgtgcgccgagaaggtgcgcttcaccgcatcagggaccgaggcctcgcacatggcgatccgtctcgcccgtgcctacaccggcaaggacaaggtcgtgcgcttcatcggccatttccatggctggcacgacaatgtcacggccggcgccggcgcgacctatgacggcggcaccacaccgggcgtgccgcagcaggtgagcgacctctcgatcgtgatgccgagcaacgacgtcgccgccgtggtcaagctgatcgaggagcgcgacgacatcgccgtggtgatgttcgagccctccggcgcctcctggggccaggtgccgctgccgccgggcttcgtccaggcggtgcgcgacgccacggccaagaagggcgtgctgatgctgatggacgaggtgatcaccggctaccgctggtcgtcgggcggcgcgcagaaggcttttggcatcacgcccgacctctgcatccaggccaagatcgtggccggcggcctgccgggcggcgcggtcgccggcaagcgcgacatcctcgaccgcatcgatcacgacgccaccgcggcgaagaagatcgagcgcatcctccatcccggcacctacaacgccaacccgttgtcggccgcggcggcggtgacggcgctcaccctggtgcgcgacgaggatctcgcggagaaggccaacaagaccgcggccgagctgcgcaaggcgctgaccgaggtgctggtgaaggagggcgtgccgtggggcatctacggccagagctcgaccttcctgatctatcccaatccgttcggcgatccgatcgatcccgcgaccttcgatccgcagaaggtgccgatcgccaagctcaagggcgcccgcggcgccggcccgctcaccggcaagatccgcatgggcctgatgacccacggcgtcgacgtgatgggtgcgcccggcggcttcgtctcggcgacccacggcggcgccgagatcgagaagaccgtccatgcgctgcgcgagaccgtgcgggcgctcaaggccgagcgcgaagtgaaggccgcgtga

SEQ ID NO: 38 - protein, 462 aa, Unknown
  Obtained from environmental sample
  DOMAIN (49)...(367): Aminotransferase class-III
  SITE (164)...(167): N-glycosylation site. Prosite id = PS00001
  SITE (347)...(350): N-glycosylation site. Prosite id = PS00001
MSTPPTNSAIITDYKARTQGSGALFERARKVLPSGITHDARYLDPYSIHVAKAKGPRKWDVDGNEYVDYFGGHGAMLLGHSHPAVVEAVKKQIELGTHYGSSHELEVRWAELVCELTPCAEKVRFTASGTEASHMAIRLARAYTGKDKVVRFIGHFHGWHDNVTAGAGATYDGGTTPGVPQQVSDLSIVMPSNDVAAVVKLIEERDDIAVVMFEPSGASWGQVPLPPGFVQAVRDATAKKGVLMLMDEVITGYRWSSGGAQKAFGITPDLCIQAKIVAGGLPGGAVAGKRDILDRIDHDATAAKKIERILHPGTYNANPLSAAAAVTALTLVRDEDLAEKANKTAAELRKALTEVLVKEGVPWGIYGQSSTFLIYPNPFGDPIDPATFDPQKVPIAKLKGARGAGPLTGKIRMGLMTHGVDVMGAPGGFVSATHGGAEIEKTVHALRETVRALKAEREVKAA

SEQ ID NO: 39 - DNA, 1077 bp, Unknown
  Obtained from environmental sample
atgcccaagcatcgcaaggctcgcttgcgtcgccaagggctggcggctaagcacggcccgacttttcgcacttcggagcctgccttgaccggtcaagtgaataccaagccccgcggccgccagttcttcaacaatccgggtccgaccaacattcccgaccgcatcctgcgggcgatggaccggccggtgatggacttcctcgcccccgaattcctcgagatgcaccgcgcctgctacgccggcatgaagcgcatcttcaagaccgaccaggaaatctacttccatgcctcgaccggccacggcgcctgggaagcggcggtcgccaacctgttctcgcccggcgacctcgtgctggtgatcgagaccggctacttctcgctgggcttcaaggagctcgccgagacgctcggcctgaaggtcgaggtggtcggcgccgactggcgcaagggcctcgagttcgcgaagctcaccgagcgcctcgccgccgacaagggccacgagatcaaggccgtgctcgccgtgcacaacgagaccgcgaccggcatggtgctgccgctcgccgaggtccgccgcgcgatggaccagaccaagcatccggcgctgctgctcagcgacaccatctcctcgctcggcagcatggaatacaagatggatgcctggggcatcgacgtcaccatcgccggcagccagaagggcctgatgctgccgaccggcatggcgatcaccggcgtcagcaagaaggcgctcgaggcctcgcgcaaggccaagctgcccaagtactacttcaactgggagctgatggagcagcgcaagccgcagcgcttcatcgggaccgtgccggtccatttcttcttcggcctgaccgagtcgatcaagatgatcgaggaggagacgctggaaggcgtgttctcccgccacgcccggctcggcgaggcgacccgcgccgcggtgcgcgcctggggcaaggacggcaagggcccgtcgctgttcggccagaccgaggaccgtctctccaactcggtcaccacggtgatgatgcccgagggccacacctccgacgccctcgtgccgaattct

SEQ ID NO: 40 - protein, 359 aa, Unknown
  Obtained from environmental sample
  DOMAIN (41)...(355): Aminotransferase class-V
  SITE (178)...(181): N-glycosylation site. Prosite id = PS00001
MPKHRKARLRRQGLAAKHGPTFRTSEPALTGQVNTKPRGRQFFNNPGPTNIPDRILRAMDRPVMDFLAPEFLEMHRACYAGMKRIFKTDQEIYFHASTGHGAWEAAVANLFSPGDLVLVIETGYFSLGFKELAETLGLKVEVVGADWRKGLEFAKLTERLAADKGHEIKAVLAVHNETATGMVLPLAEVRRAMDQTKHPALLLSDTISSLGSMEYKMDAWGIDVTIAGSQKGLMLPTGMAITGVSKKALEASRKAKLPKYYFNWELMEQRKPQRFIGTVPVHFFFGLTESIKMIEEETLEGVFSRHARLGEATRAAVRAWGKDGKGPSLFGQTEDRLSNSVTTVMMPEGHTSDALVPNS

SEQ ID NO: 41 - DNA, 852 bp, Unknown
  Obtained from environmental sample
atgtattcattatggaatgatcaaatagtgaaggatgaagaagtaaagattgataaagaagaccgaggctatcaatttggagacggcatatacgaagtaattaaagtgtatgacggtgaaatgtttacagctgaggaacatatcgatcgtttttatgaatgtgcagaaaaaattcgattaacaattccatatacgaaacataaacttcatcaattgttacatcaattagtagaagcaaatgagttaaagacaggacatatctatttccaaattacacgtggggttgcgtcacgagtacacaatttcccagcaggcaatgtgcagcctgtattatcagggacgacaaaagaatttccaagacctgtagaaaactttgaaaaaggggtaaaggcaacttttacagaagatattcgttggctacgatgtgatataaaatcactgaacttattaggtgcagtattagcgaaacaagaagcgattgaaaaagggtgttacgaagcaattttacatcgtgatggaatagtaacagaaggctcttcaacaaatgtatttggcatcaaaaatggaactctctatacacatcctgcaaacaatttaattttgcgcggaattacacgcggtgttattttaacttgtgcaaaggaaatagagctaccagtagtagagcaaccatttacgacaaaacaggcgttagaaatggatgaattatttgtttcatcaacaacttctgaaattacgccggttattgagatcgatggtgtcaaaataaataatggtgttattggagaatggacacgtaaattacaaaaacaatttgaaacgaaaattccaacaccttttacgaataaataa

SEQ ID NO: 42 - protein, 283 aa, Unknown
  Obtained from environmental sample
  DOMAIN (6)...(273): Aminotransferase class IV
  SITE (190)...(193): N-glycosylation site. Prosite id = PS00001
MYSLWNDQIVKDEEVKIDKEDRGYQFGDGIYEVIKVYDGEMFTAEEHIDRFYECAEKIRLTIPYTKHKLHQLLHQLVEANELKTGHIYFQITRGVASRVHNFPAGNVQPVLSGTTKEFPRPVENFEKGVKATFTEDIRWLRCDIKSLNLLGAVLAKQEAIEKGCYEAILHRDGIVTEGSSTNVFGIKNGTLYTHPANNLILRGITRGVILTCAKEIELPVVEQPFTTKQALEMDELFVSSTTSEITPVIEIDGVKINNGVIGEWTRKLQKQFETKIPTPFTNK

SEQ ID NO: 43 - DNA, 1350 bp, Unknown
  Obtained from environmental sample
atggctctcgaacatgcctatcgtcaagcgctcccggcctcacgcgcgctctttgagcgcgcccaacacctcttcccagacggggtcactcacgataaccgccgtatgcagccttttccaatctttgtcgaacgcgccgatggtgcctacaaatgggatgtcgatggtcgacagtacatcgactactggatgggccatggcgccctcattatggggcataaccctccgcacgtgcgtgatgccgtcattgagcaggcggcgcgtggcacgcattacggcgccagccatgctctcgaagtatcatgggccgaatgggtctgcaagctggtgccatgtgctgagcgcgtacgcttcacggcctcgggcactgaggcgacgcatatggccctgcgtctggcccgcgcctatacgggcaagcgcaatgtcatcaaattcgccgggcacttccacggctggcacgagggtctagaagtgggtgtgcaaaccccctatgagatggtgccagagccagggcaaatgcaagaggcggtggacgcagtcgccctgtgccccccgaatgatatcgaggctgtccgggctgccctcgccgctggcgacgtggccgctatcatcctcgaacctacgggtggccactttggcacggtgccggtggcgccagattttttacagcgtctacgcgaagaagccaccagggccggagtcgtactcattttcgacgaggtagtgacaggttttcgcgttgcgccaggcggggctcaggaactctacggggttacgcctgacctctccacgttcgccaaaattctcgctggtggtctaccaggtggggctgtcgctggccgcgccgagatttttcattatctggcgacgcctacaaccactgaggtgggaaagcgtgcgaagattcaccatcctggcacgttcaacgccaaccctctctcggccgcggccggtgtggccatgctgtcgtccctggccgatggtacccccatcaagcgcgccaacgagcaggctgccaagctgcggcacggcatgaacgatatcctggcacgcgaaaaagtcgcctggaaggtctacggccagcacagcgattggaagctgttctatggggctgacgccccaccgcgtgacggcgctgaccagtccgtggatgacatcccctggcagcgtcttgatggcaaattcccacagcagagccgggccatgcggcaggcgctcattttacagggcgtcgattttaacggcgcacgtgctctggtgggtacctgccatactgatgatgtggtcgctgatacgctagcgggctttgcagaggcggtgcgggccgtcaaagctgacgggctcgcgtaa

SEQ ID NO: 44 - protein, 449 aa, Unknown
  Obtained from environmental sample
  DOMAIN (42)...(375): Aminotransferase class-III
MALEHAYRQALPASRALFERAQHLFPDGVTHDNRRMQPFPIFVERADGAYKWDVDGRQYIDYWMGHGALIMGHNPPHVRDAVIEQAARGTHYGASHALEVSWAEWVCKLVPCAERVRFTASGTEATHMALRLARAYTGKRNVIKFAGHFHGWHEGLEVGVQTPYEMVPEPGQMQEAVDAVALCPPNDIEAVRAALAAGDVAAIILEPTGGHFGTVPVAPDFLQRLREEATRAGVVLIFDEVVTGFRVAPGGAQELYGVTPDLSTFAKILAGGLPGGAVAGRAEIFHYLATPTTTEVGKRAKIHHPGTFNANPLSAAAGVAMLSSLADGTPIKRANEQAAKLRHGMNDILAREKVAWKVYGQHSDWKLFYGADAPPRDGADQSVDDIPWQRLDGKFPQQSRAMRQALILQGVDFNGARALVGTCHTDDVVADTLAGFAEAVRAVKADGLA

SEQ ID NO: 45 - DNA, 1167 bp, Unknown
  Obtained from environmental sample
atgacgaagcatcgcaaggctcgcttgcgccgccaaggtctgacggctaatcacggcccgacttttcgcacttcggagcctgccttgaccgctcaagtgaataccaagccccgcggccgccagttcttcaacaatccgggtccgaccaacattcccgaccgcatcctgcgggcgatggatcgtccggtgatggatttcctcgcgccggaattcctcgagatgcaccgtgcctgctacgccggcatgaagcgcatcttcaagaccgaccaggagatctacttccacgcttcgaccggccacggcgcctgggaagcggcggtcgccaacctgttctcgccgggcgacctcgtgctggtgatcgagaccggctacttctcgctgggcttcaaggagctcgccgagacgatcggcctcaaggtcgaggtcgtcggcgccgactggcgcaagggtctcgagttcgcgaagctctccgagcgcctcgccgccgacaagggccacgagatcaaggccatcctcgccgtccacaacgagaccgcgaccggcatggtgctgccgctcgccgaggtccgccgcgcgatggaccagaccaagcatccggcgctgctgctcagtgacaccatctcctcgctcggcagcatggaatacaagatggatgcctggggcatcgacgtcaccatcgccggcagccagaagggcctgatgctgccgaccggcatggcgatcaccggcgtcagcaagaaggcgctcgaggcctcgcgcaagtccaagctgcccaagtactacttcaactgggagctgatggaggcccgcaagccgcagcgcttcatcggcaccgtgccggtccacttcttcttcggcctcaccgagtcgatcaagatgatcgaggaagagacgctggaaggcgtgttcgcccgtcacgcccgcctcgccgaggcgacccgcgccgcggtgcgcgcctggggcaaggacggcaagggtccgtcgctctacggccagaccgaggaccgtctctcgaactcggtcaccacggtgatgatgcccgagggtcacacctcggacgccatgcgcaagatcgcgctcgagcgcttcaacctgtcgctcggcggcggcctcggcccgctgatgggcaaggtgttccgcatcggccatctcggcgacctcaacgct

SEQ ID NO: 46 - protein, 389 aa, Unknown
  Obtained from environmental sample
  DOMAIN (41)...(387): Aminotransferase class-V
  SITE (178)...(181): N-glycosylation site. Prosite id = PS00001
  SITE (369)...(372): N-glycosylation site. Prosite id = PS00001
MTKHRKARLRRQGLTANHGPTFRTSEPALTAQVNTKPRGRQFFNNPGPTNIPDRILRAMDRPVMDFLAPEFLEMHRACYAGMKRIFKTDQEIYFHASTGHGAWEAAVANLFSPGDLVLVIETGYFSLGFKELAETIGLKVEVVGADWRKGLEFAKLSERLAADKGHEIKAILAVHNETATGMVLPLAEVRRAMDQTKHPALLLSDTISSLGSMEYKMDAWGIDVTIAGSQKGLMLPTGMAITGVSKKALEASRKSKLPKYYFNWELMEARKPQRFIGTVPVHFFFGLTESIKMIEEETLEGVFARHARLAEATRAAVRAWGKDGKGPSLYGQTEDRLSNSVTTVMMPEGHTSDAMRKIALERFNLSLGGGLGPLMGKVFRIGHLGDLNA

SEQ ID NO: 47 - DNA, 1401 bp, Unknown
  Obtained from environmental sample
atgagcacccccccgaccaatccgccgaccaattcggcgatcatcacggactacaaggcgcggacccaggggtccggtgcgctgtttgagcgcgcccgcaaggtgctgcccagcggcatcacgcacgatgcgcgctatctcgacccgtactcgatccacgtcgccaaggccaagggcgcccgcaagtgggatgtcgatggcaacgagtatgtggactatttcggcggccatggcgccatgctgctcggccattcgcacccggcggtggtcgaggcggtgcagaagcagatggagctcggcacgcactatggctcgagccatgagctggaggtgcgctgggccgagctggtctgcgagctgacgccgtgcgccgagaaggtgcgctttaccgcgtcgggcaccgaggcctcgcacatggcgatccgcctggcgcgcgcctacaccggcaaggacaagatcgtgcgtttcatcggccacttccacggctggcacgacaacgtgacggccggcgccggcgccacctacgacggtggcaccacgccgggcgtgccgcaggacgtgagcgcgctctcgatcgtgatgccgagcgacaacgtcgccgcggtggtgaagctgatcgaggagcgtgacgacatcgccgccgtgatgttcgagccgtcaggcgcctcgtggggccaggcgcccttgccgccgggcttcatccaggcggtgcgcgacgccacgaagaagaagggcgtcatcatgctgatggacgaggtgatcaccggctatcgctggtcgtccggcggcgcgcagaaggcgttcggcatcacgcccgacctctgcatccaggccaagatcgtcgccggcggcctgccgggcggcgcggtcgcgggcaagcgcgacatcctcgaccgcatcgatcacgacgccacggcggcgaagaagatcgagcgtatcctccatcccggcacctacaacgccaatcccttgtccgccgcggcggcggtgacggcgctcacgctggtgcgcgaccaggacctcgccgagaaggccaacaagacggcggccgaattgcgcaaggcgctgaccgaggtgctggtgaaggaaggcgtgccgtggggcatctacggccagagctcgaccttcctgatctatcccaacccgttcaacgatccgatcgatcccgcgaccttcgatccgctgaaggtgccgttcgccaagctcaagggcgcgcgcggtgcgggtccgctcaccggcaagatccgcatgggcctgatgacccatggcgtcgatgtcatgggcgcgcccggcggcttcgtctcggcgacccatggcggcgccgaaatcgagaggacggtgcacgcgctgcgcgagaccgtccgcgcgctcaaggccgagcgtgaagtgaaggcggcctaa

SEQ ID NO: 48 - protein, 466 aa, Unknown
  Obtained from environmental sample
  DOMAIN (53)...(371): Aminotransferase class-III
  SITE (168)...(171): N-glycosylation site. Prosite id = PS00001
  SITE (351)...(354): N-glycosylation site. Prosite id = PS00001
MSTPPTNPPTNSAIITDYKARTQGSGALFERARKVLPSGITHDARYLDPYSIHVAKAKGARKWDVDGNEYVDYFGGHGAMLLGHSHPAVVEAVQKQMELGTHYGSSHELEVRWAELVCELTPCAEKVRFTASGTEASHMAIRLARAYTGKDKIVRFIGHFHGWHDNVTAGAGATYDGGTTPGVPQDVSALSIVMPSDNVAAVVKLIEERDDIAAVMFEPSGASWGQAPLPPGFIQAVRDATKKKGVIMLMDEVITGYRWSSGGAQKAFGITPDLCIQAKIVAGGLPGGAVAGKRDILDRIDHDATAAKKIERILHPGTYNANPLSAAAAVTALTLVRDQDLAEKANKTAAELRKALTEVLVKEGVPWGIYGQSSTFLIYPNPFNDPIDPATFDPLKVPFAKLKGARGAGPLTGKIRMGLMTHGVDVMGAPGGFVSATHGGAEIERTVHALRETVRALKAEREVKAA

SEQ ID NO: 49 - DNA, 1353 bp, Unknown
  Obtained from environmental sample
gtgagcatcctcagcacctacgaagcgaagcaccccacctcggccgagctgcaccggcaggcgcaggggatattcccggacggcgtcacgcacgatgcccgctacttcacgcccttcccgatctacgcggagcggtcgcagggcagccacaagtgggacgtggacgggaacgagtacatcgactacgtctccggtcatggcgccctgctgctcggccacggtcgggcagaggtgacgcaggctgtggcacaacagatcgcgcggggcacgcacctcggggcatcgacgccgctggagatcgagtggggtcgctgggttcagcggttgatcccgagcgcggaacgggtgcgtttcaccagttcgggtaccgaagccgtgcaaatggctgtgcggctggcccgggccttcaccggccgcgacctgctgatcaagttcgagggacatttcaacggctggagcgacaccgtctccgccaacctgctcgcgggccacgacggtcccgcctgcgtcggcgtgcctgacgcggccaccggcctccaactgatcctccctcagaacgacatcccggccttcaccctggcgatggaggagcacgcgggcagggtcgccgccgtgatcctggagccgacgggcgcctcgatgggtggaatcccgatcgagccggagttcctcttcgccctccgggagcagacggagcgcaccggcacgctcctgatcttcgacgaggtcgtgaccggcttccggatcgcgccgggcggtacgcaggcgtacttcggcatcacgccggacctgaccacactcgccaagatcctggcgggaggtctgcccggcggcgccgtcggcggacgagcggagattctgggccagattgagttcaacccggagcactccccagcgggccgtatcgcccaccctggcacgttcaacgcgaacccgctctccgctgcggcgggcgcggcggcgctggcgatcgtcgccacgggcgagccgcaccggcgggcgaacgccgccgccgccaccctggcgcgggagatgaacgatgccctcgcgcggcgggagatcgacggctgcgtctacggcctcggctcgctgctgcacatcctgctgggcaagccgtgcgctcgtcccgaggacgggctgacctgggtctgggagggagagcaccgctcggccgtgccgcgtacgtcgccggagctggtcacggccttccgccgcggcatgctcaaccacggcgtcgatccgatggccacccggttgatcgtcggcgcggagcactcggacagcgacgtggccgccacgatcaccgcgttcgaggcgacgctggacgagatgcgggaggagcagttcctgtag

SEQ ID NO: 50 - protein, 450 aa, Unknown
  Obtained from environmental sample
  DOMAIN (42)...(371): Aminotransferase class-III
MSILSTYEAKHPTSAELHRQAQGIFPDGVTHDARYFTPFPIYAERSQGSHKWDVDGNEYIDYVSGHGALLLGHGRAEVTQAVAQQIARGTHLGASTPLEIEWGRWVQRLIPSAERVRFTSSGTEAVQMAVRLARAFTGRDLLIKFEGHFNGWSDTVSANLLAGHDGPACVGVPDAATGLQLILPQNDIPAFTLAMEEHAGRVAAVILEPTGASMGGIPIEPEFLFALREQTERTGTLLIFDEVVTGFRIAPGGTQAYFGITPDLTTLAKILAGGLPGGAVGGRAEILGQIEFNPEHSPAGRIAHPGTFNANPLSAAAGAAALAIVATGEPHRRANAAAATLAREMNDALARREIDGCVYGLGSLLHILLGKPCARPEDGLTWVWEGEHRSAVPRTSPELVTAFRRGMLNHGVDPMATRLIVGAEHSDSDVAATITAFEATLDEMREEQFL

SEQ ID NO: 51 - DNA, 1344 bp, Unknown
  Obtained from environmental sample
atgacccaaccgacaccgactgccaccgtgctcgacacctaccgcacgctccacccgaagtcgggcgccctctacgagcgggcgcgcgccgtcatcgcgggcgggatcacccacgacggccgccatctctcgccgtttccgctctacgtcgagcgcgccctcggcccgcggaagtgggacgtggacggccgcgagtacatcgactactggatgggccacggcgcgctctttctcggccactgccaccccgccgtggtcaaggccgtccaggaacaggttgcgcgcggaacccacctgggcgcctcccacgagctcgaggtgcggtgggcggagctgatcaccaagctcgtgccctccgccgaaatggtccgcttcaccatgtccggcacggaggcgacgcacctcgcccttcgcatcgcgcgcgccttcacggggcgccccaaggtggtgaagttccacggccacttccacggctggcacgacggcgtggtggcggcggtcaacccgcccttcgacgtgccgatgtcggctggcgtccccgccgccactctcgatcagctgctgctggccccgcccaatgacatcaaggcagtggagatgctgctcgagcgcggcgacgtggcggcggtgatcctcgagcccgcgggcggccagtcgggaaccacgcccaccatccccggctatctgcaggagctgcggagtctctgcacgcgtcactccgtcgtcctgatcttcgacgaggtcatcaccggcttccgctactcgcccggcggcgcccaggcgtacttcggcgtgacccccgacatgacgacgctcgccaagatcgtcgcgggcggcctcccgggggcggcggtggtggggcgcaagcccatcatgtcgatgatggcgcaccggggcgatcccgcgtgggatcggagtgagcgcgtcgcccagaacgggaccttcaactccagccccgtctgcgccgccgccgccatcgccaccctcgagctcgtgagcgacggctcgctgcacgcccgcgccaacaagctcggcgacgagctccgcaccggtgtcaccgaggtgatgaagcgcgccggtatccccgggacctgcttcggcgaggcgtcgattttccacgtgtccttcgagggcaagccgggcctcgccggcttcgaccgcccgcggcgcggcgacctctaccagcgcctgcgctgcgccctgatcaacaacggggtggactgcgcgagccagcacgggtgggtctccgccgttcacaccgacgccgacatcgagcaaacgatcgccgcccacggcaaggcgttcgcggccatggccgccgacggcagcttccgggggatgtga

SEQ ID NO: 52 - protein, 447 aa, Unknown
  Obtained from environmental sample
  DOMAIN (49)...(375): Aminotransferase class-III
  SITE (167)...(173): N-6 Adenine-specific DNA methylases signature. Prosite id = PS00092
  SITE (316)...(319): N-glycosylation site. Prosite id = PS00001
MTQPTPTATVLDTYRTLHPKSGALYERARAVIAGGITHDGRHLSPFPLYVERALGPRKWDVDGREYIDYWMGHGALFLGHCHPAVVKAVQEQVARGTHLGASHELEVRWAELITKLVPSAEMVRFTMSGTEATHLALRIARAFTGRPKVVKFHGHFHGWHDGVVAAVNPPFDVPMSAGVPAATLDQLLLAPPNDIKAVEMLLERGDVAAVILEPAGGQSGTTPTIPGYLQELRSLCTRHSVVLIFDEVITGFRYSPGGAQAYFGVTPDMTTLAKIVAGGLPGAAVVGRKPIMSMMAHRGDPAWDRSERVAQNGTFNSSPVCAAAAIATLELVSDGSLHARANKLGDELRTGVTEVMKRAGIPGTCFGEASIFHVSFEGKPGLAGFDRPRRGDLYQRLRCALINNGVDCASQHGWVSAVHTDADIEQTIAAHGKAFAAMAADGSFRGM

SEQ ID NO: 53 - DNA, 861 bp, Unknown
  Obtained from environmental sample
atgaaaatgatcggatattataacggagtgcttggcaatctgcaggaaatgcagattccgatgcaggatcgggcgctgtatttcggagacggcgtctatgatttcactcctgcctacaacggcaaactgtttgccatcgaagaccatctcgaccgttttttccattccatggaaatgctgtcgatccgcccttactgtgatcgggaaactctgaagaaggaactggaacgctgcgtggcggcgacggaaagcacggaaccgatggcggtttactggcagacttcccgcggcaactgccggcgcaatcatatttttccgccggagggaacaccgactacgcttctgatcacggtcacaccattgaaaccgctggatccgaatgtatcactgaagctggcttcgtttgaagacaagcgttttcagtactgcaatatcaagacactgaatctgattcccaatgttctggccgcgcagtacgcggaagagcagggatgtcaggaagctgtgttccaccgcggtaagtttgtaatggaatgcgcccacagttcactcgtcctgctgaaggacggtgtactgatggcaccgccgctcgatgacaggatactgccgtccatcacccgcaaacatatcacggccatctgcaaaacactggatgttccggtcgaggaaagaaagatcacgatggatgaactgtatgaagcggacgaactgatcgttctgagttccagcaagctgattgcccgggccaatgtactggatggcaaaccggtcggcatgagtgactccatgctgttcacgatgatccgagacgcatatttcaggatggtcgaaaaagaaaccggctatcgtatcggagagtga

SEQ ID NO: 54 - protein, 286 aa, Unknown
  Obtained from environmental sample
  DOMAIN (8)...(273): Aminotransferase class IV
  SITE (128)...(131): N-glycosylation site. Prosite id = PS00001
MKMIGYYNGVLGNLQEMQIPMQDRALYFGDGVYDFTPAYNGKLFAIEDHLDRFFHSMEMLSIRPYCDRETLKKELERCVAATESTEPMAVYWQTSRGNCRRNHIFPPEGTPTTLLITVTPLKPLDPNVSLKLASFEDKRFQYCNIKTLNLIPNVLAAQYAEEQGCQEAVFHRGKFVMECAHSSLVLLKDGVLMAPPLDDRILPSITRKHITAICKTLDVPVEERKITMDELYEADELIVLSSSKLIARANVLDGKPVGMSDSMLFTMIRDAYFRMVEKETGYRIGE

SEQ ID NO: 55 - DNA, 396 bp, Unknown
  Obtained from environmental sample
atgcgctacgccaagctcacccaacgcatcgccggcgacggggctgccgcctgggacatccactaccgcgccttggcaatgcaggccgagggcaaggacatcctgctgctgtcggtgggtgacccggatttcgacacccccgcgccgatcgtcgaggcggccatcggcagcctacgtgccggccatactcattacgctgatgtgcgcggcaaggtggcgctgcgccaggccattgccaaccgccaccggcagcgcagcggccaggcggtgaacgccggccaggtgacagtgctggcaggggcgcagtgcgcgctgttctgcgtggcccagtgcgtgcttgacccaggtgacgaggtgattgtcgccgaacccatgtacgtgacctacgaagccgtg

SEQ ID NO: 56 - protein, 132 aa, Unknown
  Obtained from environmental sample
MRYAKLTQRIAGDGAAAWDIHYRALAMQAEGKDILLLSVGDPDFDTPAPIVEAAIGSLRAGHTHYADVRGKVALRQAIANRHRQRSGQAVNAGQVTVLAGAQCALFCVAQCVLDPGDEVIVAEPMYVTYEAV

SEQ ID NO: 57 - DNA, 396 bp, Unknown
  Obtained from environmental sample
atgcgctacgccaagctcacccaacgcatcgccggcgacggggctgccgcctgggacatccactaccgcgccttggcaatgcaggccgagggcaaggacatcctgctgctgtcggtgggtgacccggatttcgacacccccgcgccgatcgtcgaggcggccatcggcagcctacgtgccggccatactcattacgctgatgtgcgcggcaaggtggcgctgcgccaggccattgccaaccgccaccggcagcgcagcggccaggcggtgaacgccggccaggtgacagtgctggcaggggcgcagtgcgcgctgttctgcgtggcccagtgcgtgcttgacccaggtgacgaggtgattgtcgccgagcccatgtacgtcacttacgaaggcgtg

SEQ ID NO: 58 - protein, 132 aa, Unknown
  Obtained from environmental sample
MRYAKLTQRIAGDGAAAWDIHYRALAMQAEGKDILLLSVGDPDFDTPAPIVEAAIGSLRAGHTHYADVRGKVALRQAIANRHRQRSGQAVNAGQVTVLAGAQCALFCVAQCVLDPGDEVIVAEPMYVTYEGV

SEQ ID NO: 59 - DNA, 396 bp, Unknown
  Obtained from environmental sample
atgcgctacgccaagctcacccaacgcatcgccggcgacggggctgccgcctgggacatccactaccgcgccttggcaatgcaggccgagggcaaggacatcctgctgctgtcggtgggtgacccggatttcgacacccccgcgccgatcgtcgaggcggccatcggcagcctacgtgccggccatactcattacactgatgtgcgcggcaaggtggcgctgcgccaggccattgccaaccgccaccggcagcgcagcggccaggcggtgaacgccggccaggtgacagtgctggcaggggcgcagtgcgcgctgttctgcgtggcccagtgcgtgcttgacccaggtgacgaggtgattgtcgccgaacccatgtatgtgacctacgaaggcgtg

SEQ ID NO: 60 - protein, 132 aa, Unknown
  Obtained from environmental sample
MRYAKLTQRIAGDGAAAWDIHYRALAMQAEGKDILLLSVGDPDFDTPAPIVEAAIGSLRAGHTHYTDVRGKVALRQAIANRHRQRSGQAVNAGQVTVLAGAQCALFCVAQCVLDPGDEVIVAEPMYVTYEGV

SEQ ID NO: 61 - DNA, 396 bp, Unknown
  Obtained from environmental sample
atgcgctacgccaagctcacccaacgcatcgccggcgacggggctgccgcctgggacatccactaccgcgccttggcaatgcaggccgagggcaaggacatcctgctgctgtcggtgggtgacccggatttcgacacccccgcgccgatcgtcgaggcggccatcggcagcctacgtgccggccatactcattacgctgatgtgcgcggcaaggtggcgctgcgccaggccattgccaaccgccaccggcagcgcagcggccaggcggtgaacgccggccaggtgacagtgctggcaggggcgcagtgcgcgctgttctgcgtggcccagtgcgtgcttgacccaggtgacgaggtgattgtcgccgaaccgatgtacgtgacctacgaggccgtg

SEQ ID NO: 62 - protein, 132 aa, Unknown; identical to SEQ ID NO: 56
  Obtained from environmental sample

SEQ ID NO: 63 - DNA, 396 bp, Unknown
  Obtained from environmental sample
atgcgctacgccaagcttacccaacgcatcgccggtgacggggctgccgcctgggacatccactaccgcgccctggcgctacaggccgaaggcaaggacatcctgctgttgtcggtgggtgacccggacttcgatacccccacgccaatcgtcgaggcggccatcgacagcctgcgcgccggccacacccattacgccgatgtgcgcggcaagcaggcgctgcgccaggccatcgccaaccgccaccggctgcgcagcggccaagcggtgaaagccgagcaggtgacggtactggcaggggcgcagtgcgcgctgttctgcgtggcccagtgcgtgcttgacccgggggatgaagtgatcgttgccgaaccgatgtacgtcacctacgagggcgtg

SEQ ID NO: 64 - protein, 132 aa, Unknown
  Obtained from environmental sample
MRYAKLTQRIAGDGAAAWDIHYRALALQAEGKDILLLSVGDPDFDTPTPIVEAAIDSLRAGHTHYADVRGKQALRQAIANRHRLRSGQAVKAEQVTVLAGAQCALFCVAQCVLDPGDEVIVAEPMYVTYEGV

SEQ ID NO: 65 - DNA, 396 bp, Unknown
  Obtained from environmental sample
atgcgctactcccaccttacccaacgcatagccggtgacggcgccgccgcctgggatatccactaccgcgcgctggcgcgcctggagcagggcgacgacatcctcctgctgtcggtcggcgatccggatttcgatacgccgcagcccatcgtgcaggcggctgtggatagcctgcgtgctggcgccacccattacgccgatgtcagcggcaagcgtgccctgcgcgaggccattgctgctcgtcacgggaagcgcagcggccagttggtggacgccgatcaggtgatcgtgctcgccggtgcccagtgcgcgctctacgcagtggcccagtgcgtgctgaatccgggcgacgaggtaatcgtcgccgagcccatgtacgtgacctatgaggccgtg

SEQ ID NO: 66 - protein, 132 aa, Unknown
  Obtained from environmental sample
MRYSHLTQRIAGDGAAAWDIHYRALARLEQGDDILLLSVGDPDFDTPQPIVQAAVDSLRAGATHYADVSGKRALREAIAARHGKRSGQLVDADQVIVLAGAQCALYAVAQCVLNPGDEVIVAEPMYVTYEAV

SEQ ID NO: 67 - DNA, 396 bp, Unknown
  Obtained from environmental sample
atgcgctactcccaccttacccaacgcatagccggtgacggcgccgccgcctgggatatccactaccgcgcgctggcgcgcctggagcagggcgacgacatcctcctgctgtcggtcggcgatccggatttcgatacgccgcagcccatcgtgcaggcggctgtggatagcctgcgtgctggcgccacccattacgccgatgtcagcggcaagcgtgccttgcgcgaggccattgctgctcgtcacgggaagcgcagcggccagttggtggacgccgatcaggtgatcgtgctcgccggcgcccagtgcgcgctctacgcagtggcccagtacgtgctgaatccgggcgacgaggtaatcgtcgccgagccgatgtatgtgacttacgaagccgtg

SEQ ID NO: 68 - protein, 132 aa, Unknown
  Obtained from environmental sample
MRYSHLTQRIAGDGAAAWDIHYRALARLEQGDDILLLSVGDPDFDTPQPIVQAAVDSLRAGATHYADVSGKRALREAIAARHGKRSGQLVDADQVIVLAGAQCALYAVAQYVLNPGDEVIVAEPMYVTYEAV

SEQ ID NO: 69 - DNA, 396 bp, Unknown
  Obtained from environmental sample
atgcgctactcccaccttacccaacgcatagccggtgacggcgccgccgcctgggatatccactaccgcgcgctggcgcgcctggagcagggcgacgacatccttctgctgtcggtcggcgatccggatttcgatacgccgcagcccatcgtgcaggcggctgtggatagcctgcgtgctggcgccacccattacgccgatgtcagcggcaagcgtgccctgcgcgaggccattgctgctcgtcacgggaagcgcggcggccagttggtggacgccgatcaggtgatcgtactcgctggcgcccagtgcgcgctctacgcagtggcccagtgcgtgctgaatccgggcgacgaggtaatcgtcgccgagccgatgtatgtgacctatgaagccgtg

SEQ ID NO: 70 - protein, 132 aa, Unknown
  Obtained from environmental sample
MRYSHLTQRIAGDGAAAWDIHYRALARLEQGDDILLLSVGDPDFDTPQPIVQAAVDSLRAGATHYADVSGKRALREAIAARHGKRGGQLVDADQVIVLAGAQCALYAVAQCVLNPGDEVIVAEPMYVTYEAV

SEQ ID NO: 71 - DNA, 396 bp, Unknown
  Obtained from environmental sample
atgcgctacgccaagctcactcaacgcatcgccggcgacggggctgcggcctgggacatccactaccgcgccctggcgctgcaggccgagggcagggatatcctgctgctgtcggtgggtgacccggacttcgacacccccgcgccgatcgtcgaggcggccatcgacagcctgcgtgcaggccatacccattacgccgatgtgcgcggcaagctggcgctgcgccaggccatcgccaaccgccaccggcagcgcagcggccaggccgtcgatgccgaccaggtgacggtgctggcgggggcccaatgtgcgctgtactgcgtggcccagtgcgtgctcgacccgggtgacgaggtgattgtcgccgagccgatgtacgtgacttacgaggccgtg

SEQ ID NO: 72 - protein, 132 aa, Unknown
  Obtained from environmental sample
MRYAKLTQRIAGDGAAAWDIHYRALALQAEGRDILLLSVGDPDFDTPAPIVEAAIDSLRAGHTHYADVRGKLALRQAIANRHRQRSGQAVDADQVTVLAGAQCALYCVAQCVLDPGDEVIVAEPMYVTYEAV

SEQ ID NO: 73 - DNA, 396 bp, Unknown
  Obtained from environmental sample
atgcgctacgccaagctcactcaacgcatcgccggcgacggggctgcggcctgggacatccactaccgcgccctggcgctgcaggccgagggcaaggatatcctgctgctgtcggtgggtgacccggacttcgacacccccgcgccgatcgtcgaggcggccgtcgacagcctgcgtgcgggccacacccattacgctgatgtgcgcggcaagctggcgctgcgccaggccatcgccaaccgccaccggcagcgcagcggccaggccgtcgatgccgaccaggtgacggtgctggcgggggcccagtgcgcgctgtactgcgtggcccagtgcgtgctcgacccgggcgacgaggtgattgtcgccgagcccatgtacgtgacctatgaggccgtg

SEQ ID NO: 74 - protein, 132 aa, Unknown
  Obtained from environmental sample
MRYAKLTQRIAGDGAAAWDIHYRALALQAEGKDILLLSVGDPDFDTPAPIVEAAVDSLRAGHTHYADVRGKLALRQAIANRHRQRSGQAVDADQVTVLAGAQCALYCVAQCVLDPGDEVIVAEPMYVTYEAV

SEQ ID NO: 75 - DNA, 873 bp, Unknown
  Obtained from environmental sample
atgagcacagtatatttaaatggccagtttatgccggccagcgaagcgcggatttcaccaatggatcgtggctttttatttggtgacggaatctatgaggtgatcccaacctatcacggtcgttatgttggctttgcgccgcatatcgcacggatgcatgaaggcttagctgcacttaatattcagcatggtatgaccgagcagcgctggcgcgagctttgcgatcagctgctcgagctaaaccggccagaactgggtgagaatttgggcgtttatattcaggtcagccgcggtgccgataccaaacgcaaccatgcctttccaagtggtatcagcccaaccatttttgcctatacctttgccatcgccgccgagccggtgccggataaaagcaaggtcagcacctatagtgtggttaccgccaacgacttacgctggcagcgctgccatattaaatccacctctttgctgggtaatgtgctgcattatcaatacggcgtggaacagggcgcgcaggaaaccctgctatttgaccgcgacggcaacttaaccgaaggcgcggcagtaaatgtatttgtggtaaaaaacggcgaaattgctaccccgccgctaagtaataagctgttacccggtgtcacccgcttactgctgctggcgatcctgcgccaacactcggatttaaaggtggtagagcgtgagattagcttcgacgaagtattggctgccgatgaaatctggctaaccagctccagtaaagaaattgcgccggtagttaaggttaatggccagccggtgggggatggcactgtgggtgatatctggctggcggcgcagcggttgtttagtgagcataagtatagtgttgagtgttga

SEQ ID NO: 76 - protein, 290 aa, Unknown
  Obtained from environmental sample
  DOMAIN (7)...(282): Aminotransferase class IV
  SITE (184)...(187): N-glycosylation site. Prosite id = PS00001
MSTVYLNGQFMPASEARISPMDRGFLFGDGIYEVIPTYHGRYVGFAPHIARMHEGLAALNIQHGMTEQRWRELCDQLLELNRPELGENLGVYIQVSRGADTKRNHAFPSGISPTIFAYTFAIAAEPVPDKSKVSTYSVVTANDLRWQRCHIKSTSLLGNVLHYQYGVEQGAQETLLFDRDGNLTEGAAVNVFVVKNGEIATPPLSNKLLPGVTRLLLLAILRQHSDLKVVEREISFDEVLAADEIWLTSSSKEIAPVVKVNGQPVGDGTVGDIWLAAQRLFSEHKYSVEC

SEQ ID NO: 77 - DNA, 873 bp, Unknown; identical to SEQ ID NO: 75
  Obtained from environmental sample

SEQ ID NO: 78 - protein, 290 aa, Unknown; identical to SEQ ID NO: 76
  Obtained from environmental sample
  DOMAIN (7)...(282): Aminotransferase class IV
  SITE (184)...(187): N-glycosylation site. Prosite id = PS00001

SEQ ID NO: 79 - DNA, 396 bp, Unknown
  Obtained from environmental sample
atgcgctacgccaagcttacccaacgcatcgccggcgacggggctgcggcctgggacatccactaccgcgccctggcgctgcaggccgagggcaaggacatcctgctgctgtcggtgggtgacccggacttcgacacccccggcccgattgtcgaggcggccatcgacagcctgcgtgcaggccacacccattacgccgatgtacgcggcaagctggccctgcgccaggccatcgccaagcgccaccagcagcgtagcggccaggccgtcaacgccgaccaggtgacggtgctggcgggcgctcagtgcgcgctgtactgcgtggcccagtgcgtgctggacccaggcgacgaggtgcttgtcgccgaacccatgtacgtcacctcgaagccgtga

SEQ ID NO: 80 - protein, 131 aa, Unknown
  Obtained from environmental sample
MRYAKLTQRIAGDGAAAWDIHYRALALQAEGKDILLLSVGDPDFDTPGPIVEAAIDSLRAGHTHYADVRGKLALRQAIAKRHQQRSGQAVNADQVTVLAGAQCALYCVAQCVLDPGDEVLVAEPMYVTSKP

SEQ ID NO: 81 - DNA, 393 bp, Unknown
  Obtained from environmental sample
atgcgctacgccaagcttacccaacgcatcgccggcgacggggctgcggcctgggacatccactaccgcgccctggcgctgcaggccgagggcaaggacatcctgctgctgtcggtgggtgacccggacttcgacacccccggcccgattgtcgaggcggccatcgacagcctgcgtgcaggccacacccattacgccgatgtacgcggcaagctggccctgcgccaggccatcgccaagcgccaccagcagcgtagcggccaggccgtcaacgccgaccaggtgacggtgctggcgggcgctcagtgcgcgctgtactgcgtggcccagtgcgtgctggacccaggcgacgaggtgcttgtcgccgaacccatgtacgtcacttatgaggca

SEQ ID NO: 82 - protein, 131 aa, Unknown
  Obtained from environmental sample
MRYAKLTQRIAGDGAAAWDIHYRALALQAEGKDILLLSVGDPDFDTPGPIVEAAIDSLRAGHTHYADVRGKLALRQAIAKRHQQRSGQAVNADQVTVLAGAQCALYCVAQCVLDPGDEVLVAEPMYVTYEA

SEQ ID NO: 83 - DNA, 1398 bp, Unknown
  Obtained from environmental sample
atgagcaccccgaccaatccggcgaccaattcggccatcgtcaccgactacaaggcacggacccagggctcgggtgcgctgtttgaacgcgcccgcaaggtgctcccgagcggcatcacgcacgatgcgcgctatctcgacccctattcgatccacgtcgccaaggccaagggcccgcgcaaatgggacgtcgatggcaacgaatatgtggactatttcggtggccacggcgccatgctgctcggccattcgcaccccgcggtgatcgaggcggtcaagaagcagatggagctgggcacgcactacggctcgagccacgagctcgaggtgcgctgggccgagctggtgtgcgagctgacgccctgtgccgagaaggtgcgcttcaccgcctcgggcaccgaggcgtcgcacatggcgatacgtttggcgcgtgcctacaccggcaaggagaagatcgtccgcttcatcggccacttccacggctggcacgacaacgtcacagccggcgcgggcgcgacctacgacggcggcaccacgccgggcgtgccgcaggaggtgagctctctttcgatcgtcatgccgagcgacaacgtcgccgcggtcgtgaagctgatcgaggagcgcgacgacatcgccgcggtgatgttcgagccgtccggcgcctcgtggggccaggcgccgctgccgccgggcttcatccaggcggtgcgcgacgccacggccaagaagggcgtcgtcatgctgatggacgaggtcatcaccggctatcgctggtcgtcgggcggcgcgcagaaggcgttcggcatcacgcccgacctctgcatccaggccaagatcgtcgccggcggcctgccgggcggcgcggtcgcgggcaagcgcgagatcctcgatcgcatcgatcacgatgcgacggcggccaagaagatcgagcgcatcctccatcccggcacctacaacgccaacccgttgtcggccgccgcggcggtgacggcgctcaccctagtgcgcgacgaggatctctcggagaaggccaacaagaccgcggccgagctgcgcgcggcgctcaccgaggtgctggtgaaggagagcgtgccgtggggcatctacggccagagctcgaccttcctgatctatcccaacccgttcaacgatccggtcgatcccgcgaccttcgatccgctcaaggtgccgttcgccaagctcaagggtgcgcgcggcgcgggtccgctcaccggcaagatccgcatgggcctgatgacccacggcgtcgacgtgatgggcgcgcccggcggcttcgtctcggcgacccacggcggcggcgagatcgagaagaccgtccacgccttgcgcgagacggtgcgcgcgctcaaggccgagcgggaagtgaaagccgcctga

SEQ ID NO: 84 - protein, 465 aa, Unknown
  Obtained from environmental sample
  DOMAIN (52)...(365): Aminotransferase class-III
  SITE (167)...(170): N-glycosylation site. Prosite id = PS00001
  SITE (350)...(353): N-glycosylation site. Prosite id = PS00001
MSTPTNPATNSAIVTDYKARTQGSGALFERARKVLPSGITHDARYLDPYSIHVAKAKGPRKWDVDGNEYVDYFGGHGAMLLGHSHPAVIEAVKKQMELGTHYGSSHELEVRWAELVCELTPCAEKVRFTASGTEASHMAIRLARAYTGKEKIVRFIGHFHGWHDNVTAGAGATYDGGTTPGVPQEVSSLSIVMPSDNVAAVVKLIEERDDIAAVMFEPSGASWGQAPLPPGFIQAVRDATAKKGVVMLMDEVITGYRWSSGGAQKAFGITPDLCIQAKIVAGGLPGGAVAGKREILDRIDHDATAAKKIERILHPGTYNANPLSAAAAVTALTLVRDEDLSEKANKTAAELRAALTEVLVKESVPWGIYGQSSTFLIYPNPFNDPVDPATFDPLKVPFAKLKGARGAGPLTGKIRMGLMTHGVDVMGAPGGFVSATHGGGEIEKTVHALRETVRALKAEREVKAA

SEQ ID NO: 85 - DNA, 873 bp, Unknown
  Obtained from environmental sample
atgagcacgttgccgatctgctatctgaacggcgattatctgccgctcaccgaggcgcgggtgtcgcccctcgatcgggcattcctgttcggggacgcggtctacgaggtcgtcatggtggcgggtgcgcgcccgtttcgcctgcaacagcatctcgatcgcctccagcgcagtctcgccggcatccgcatgacgccacccctcgagcacgaggcctggggccgcatttgcgccgagctgatcgagcgcaatgacgccgagaatgcccacatctacatgcaggtcacccgcggtgcagagctcgggcgcaatcacgcgtggccggacggactgccgcccacggtgttcgcctacgccagcgtcatggagcccttgagccgcgcggcgctcgacaacggcgtcaccgcgatcaccgccgcggacacccgttgggcccggcgtgacatcaagtccaccgcattgctcgccaacgtgctcttgaagaggctggccgtggatgccggcgcgttcgagaccatcctgctcgagaacggcgagctcaacgaaggctcatccaccacggttcatgtggtcaagagcggacggatcgcctgtccgccgaacgggacgcatattctcccgggaaccacccgcgatgtggtgacggagctcgcgcagcgcaacggcattcccacggaaagccgccgcgtcaaggagtcggagctgcgcgatgccgacgagatatggctggctttctccacccgcggcttgttgccggtgacccggctcgacggcgcggcggtcgggtccggcaagccggggccgctgttcaagcgggttcacgacgcgttcgagcggcatctcgtcgagcttcgggggacgccggcgctgtag

SEQ ID NO: 86 - protein, 290 aa, Unknown
  Obtained from environmental sample
  DOMAIN (10)...(278): Aminotransferase class IV
  SITE (204)...(207): N-glycosylation site. Prosite id = PS00001
MSTLPICYLNGDYLPLTEARVSPLDRAFLFGDAVYEVVMVAGARPFRLQQHLDRLQRSLAGIRMTPPLEHEAWGRICAELIERNDAENAHIYMQVTRGAELGRNHAWPDGLPPTVFAYASVMEPLSRAALDNGVTAITAADTRWARRDIKSTALLANVLLKRLAVDAGAFETILLENGELNEGSSTTVHVVKSGRIACPPNGTHILPGTTRDVVTELAQRNGIPTESRRVKESELRDADEIWLAFSTRGLLPVTRLDGAAVGSGKPGPLFKRVHDAFERHLVELRGTPAL

SEQ ID NO: 87 - DNA, 879 bp, Unknown
  Obtained from environmental sample
gtggtttatctgaacgggcgttttgtccccatggaggaagccgtcgttcccatcgaggaccgcggctaccaatttgctgatggtgtctacgatgttttgaaatttcacgggcgttgcgctgtgcggctgacggcccacctcgaacgtcttgcggaaagctgcgcggggttgcgcattgaaggcgtgccttcggcccaggggtggcgctccatcatcgcggagttggccgagcgcagcgaacttggccacacgtttgacgacactgtcattctctacattcaggttacgcgaggagtggcttcgcgcattcactatttccccgagccgcgccccaagcccacggtcctggcctatttcaaagcggctcccgtttaccccgaggcattgcgtcgcgacggggcctcagtgatcacgatgcccgatgagcgctggggtcgctgtcacatcaagagcattgcccttttgcctgtcgtcctggccaagcaagcggcgcgcgaggccggtgctctcgaggcgcttctcgtgcgcgacgggatcgtgactgagggcggcgcgtcgaatgccttctgtgtgcgccagggagtcatcttcacgcacccggagggcccccgcattctctcaggggtcacgcgcggcattgttctcgatgcagcacgacgccttggcattgaggtgcgtgaggagcccgttcccatcgaagagttccgtgcggcggacgaggcgtttctttcgagcacaaccatgaacgtcatgcctgtgacgcgtatcaatggcgctcccgtcggaagcggagctgttggggaagtcacgcgctccatcgcggcggcggtcgaagaactcattcgggaggagcatgaagccaacgcgtccctcggatga

SEQ ID NO: 88 - protein, 292 aa, Unknown
  Obtained from environmental sample
  DOMAIN (5)...(278): Aminotransferase class IV
  SITE (292)...(295): N-glycosylation site. Prosite id = PS00001
MVYLNGRFVPMEEAVVPIEDRGYQFADGVYDVLKFHGRCAVRLTAHLERLAESCAGLRIEGVPSAQGWRSIIAELAERSELGHTFDDTVILYIQVTRGVASRIHYFPEPRPKPTVLAYFKAAPVYPEALRRDGASVITMPDERWGRCHIKSIALLPVVLAKQAAREAGALEALLVRDGIVTEGGASNAFCVRQGVIFTHPEGPRILSGVTRGIVLDAARRLGIEVREEPVPIEEFRAADEAFLSSTTMNVMPVTRINGAPVGSGAVGEVTRSIAAAVEELIREEHEANASLG

SEQ ID NO: 89 - DNA, 396 bp, Unknown
  Obtained from environmental sample
atgcgctttgccaagctgacccaacgcattgccggcgacggcgccgccgcctgggacatccactaccgcgccctggcgatgcaggccgagggcaaggacgtcctgctgctgtcggtgggggacccggatttcgacacgccggcgcccatcgtcgaggcagccatcgacagcctgcgcgatggtcacacccattactccgacgtgcgcggcaagctggccttgcgccaggcgatcgcccgtcgtcaccagcagcgcagtggccaggcggttagcgccgaccaggtcacggtgctggccggtgcgcagtgcgcgctgttctgcgtggcccaatgcgtgctcgatccgggcgacgaggtgatcgtcgccgagcccatgtatgtcacctacgaagccgtg

SEQ ID NO: 90 - protein, 132 aa, Unknown
  Obtained from environmental sample
MRFAKLTQRIAGDGAAAWDIHYRALAMQAEGKDVLLLSVGDPDFDTPAPIVEAAIDSLRDGHTHYSDVRGKLALRQAIARRHQQRSGQAVSADQVTVLAGAQCALFCVAQCVLDPGDEVIVAEPMYVTYEAV

SEQ ID NO: 91 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaaccgatgtatgtcacctatgagggcgtg

SEQ ID NO: 92 - protein, 132 aa, Unknown
  Obtained from environmental sample
MRYAKLTQRIAGDGAAAWDIHYRALALQAEGKDILLLSVGDPDFDTPTPIVEAAIDSLRAGHTHYADVRGKQALRQAIADRHRLRSGQAVKAEQVTVLAGAQCALFCVAQCVLDPGDEVIVAEPMYVTYEGV

SEQ ID NO: 93 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaaccgatgtacgtgacttacgaaggcgtg

SEQ ID NO: 94 - protein, 132 aa, Unknown; identical to SEQ ID NO: 92
  Obtained from environmental sample

SEQ ID NO: 95 - DNA, 396 bp, Unknown
  Obtained from environmental sample
atgcgctacgccaagctcacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaacccatgtacgtcacctatgaaggcgtg

SEQ ID NO: 96 - protein, 132 aa, Unknown; identical to SEQ ID NO: 92
  Obtained from environmental sample

SEQ ID NO: 97 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaacccatgtacgtcacctacgaggccgtg

SEQ ID NO: 98 - protein, 132 aa, Unknown
  Obtained from environmental sample
MRYAKLTQRIAGDGAAAWDIHYRALALQAEGKDILLLSVGDPDFDTPTPIVEAAIDSLRAGHTHYADVRGKQALRQAIADRHRLRSGQAVKAEQVTVLAGAQCALFCVAQCVLDPGDEVIVAEPMYVTYEAV

SEQ ID NO: 99 - DNA, 390 bp, Unknown
  Obtained from environmental sample
atgcgctacgccacgctcacccaacgcatcgccggcgacggggctgcggcctgggacatccactaccgcgccctggcgctgcaggccgagggcaaggacatcctgttgctgtcggtgggtgacccggacttcgacacccctgcgccgattgtccaggcggccatcgacagcctgcgagcgggccacacccattacgccgatgtgcgcggcaagctggccctgcgccaggccattgccaaccgccaccggcagcgcagcggccaagccgtcagtgcggaccaggtgacggtgctggcaggtgcgcagtgtgcgttgtactgcgtcgcccagtgcgtcctggacccaggcgacgaagtgctcgtcgccgagccgatgtacgtcacctacgag

SEQ ID NO: 100 - protein, 130 aa, Unknown
  Obtained from environmental sample
MRYATLTQRIAGDGAAAWDIHYRALALQAEGKDILLLSVGDPDFDTPAPIVQAAIDSLRAGHTHYADVRGKLALRQAIANRHRQRSGQAVSADQVTVLAGAQCALYCVAQCVLDPGDEVLVAEPMYVTYE

SEQ ID NO: 101 - DNA, 396 bp, Unknown
  Obtained from environmental sample
atgcgctacgccaagctcactcaacgcatcgccggcgacggggccgcagcctgggacatccactaccgcgccctggcgctgcaggccgagggcaaggatatcctgctgctgtcggtgggtgacccggacttcgacacccccgcgccgatcgtcgaggcggccatcgacagcctgcgagcgggccacacccattacgccgatgtgcgcggcaagctggcgctgcgccaggccatcgccaaccgccaccgccagcgcagcggccaggccgtcgatgccgaccaggtgacggtgctggcgggagcccaatgtgcgctgtactgcgtggcccagtgcgtgctcgacccgggtgacgaagtgattgtcgccgagcccatgtacgtgacctacgaagcgtga

SEQ ID NO: 102 - protein, 131 aa, Unknown
  Obtained from environmental sample
MRYAKLTQRIAGDGAAAWDIHYRALALQAEGKDILLLSVGDPDFDTPAPIVEAAIDSLRAGHTHYADVRGKLALRQAIANRHRQRSGQAVDADQVTVLAGAQCALYCVAQCVLDPGDEVIVAEPMYVTYEA

SEQ ID NO: 103 - DNA, 396 bp, Unknown
  Obtained from environmental sample
atgcgctacgccaagctcactcaacgcatcgccggcgacggggctgccgcctgggacatccactatcgcgccctggcactgcaggccgagggcaaggacatcctgctactgtcggtgggtgacccggacttcgacacccccgcgccgatcgtcgaggcggccatcgacagcctgcgtgcaggccacacccattacgccgatgtgcgcggcaagctggcgctgcgccaggccatcgccaagcgccaccgacagcgcagcggccaggcggtcgatgccgtccaggtgacggtgctggcgggggcgcagtgcgcgctgtactgcgtggcccagtgcctgctcgacccgggtgacgaggtgatcgtcgccgagccgatgtacgtcacctacgaaggcgtg

SEQ ID NO: 104 - protein, 132 aa, Unknown
  Obtained from environmental sample
MRYAKLTQRIAGDGAAAWDIHYRALALQAEGKDILLLSVGDPDFDTPAPIVEAAIDSLRAGHTHYADVRGKLALRQAIAKRHRQRSGQAVDAVQVTVLAGAQCALYCVAQCLLDPGDEVIVAEPMYVTYEGV

SEQ ID NO: 105 - DNA, 396 bp, Unknown
  Obtained from environmental sample
atgcgctacgccaagctcactcaacgcatcgccggcgacggggccgcggcctgggacatccactaccgcgccctggcgctgcaggccgagggcaaggacgtcctgctgctgtcggtgggtgacccggacttcgacacccccgcgccgatcgtcgaggcggccatcgacagcctgcatgcgggcaatacccattatgccgatgtgcgcggcaagctggcgctgcgccaggcaatcgccaaccgccaccggcagcgcagcggccaggccgtcgatgccgaccaggtgacggtgctggcgggggcccaatgcgcgctgtactgcgtggcccagtgcgtgctcgacccgggtgacgaggtgattgtcgccgagcccatgtacgtcacctacgaaggcgtg

SEQ ID NO: 106 - protein, 132 aa, Unknown
  Obtained from environmental sample
MRYAKLTQRIAGDGAAAWDIHYRALALQAEGKDVLLLSVGDPDFDTPAPIVEAAIDSLHAGNTHYADVRGKLALRQAIANRHRQRSGQAVDADQVTVLAGAQCALYCVAQCVLDPGDEVIVAEPMYVTYEGV

SEQ ID NO: 107 - DNA, 396 bp, Unknown
  Obtained from environmental sample
atgcgctacgccaagctcacccaacgcatcgccggcgacggggctgctgcctgggacatccgctaccgcgccctggcgctgcaggccgaaggcaaggacatcctgctgttgtcggtgggtgacccggacttcgatacccccacgccaatcgtcgaggcggccatcgacagcctgcgcgccggccacacccattacgccgatgtgcgcggcaagcaggcgctgcgccaggccatcgccaaccgccaccggctgcgcagtggccaagcggtgaacgccgagcaggtgacggtactggcaggtgcgcagtgcgcgctgttctgcgtggcccagtgcgtgcttgacccgggcgatgaagtgatcgttgccgaaccgatgtacgtcacctacgaaggcgtg

SEQ ID NO: 108 - protein, 132 aa, Unknown
  Obtained from environmental sample
MRYAKLTQRIAGDGAAAWDIRYRALALQAEGKDILLLSVGDPDFDTPTPIVEAAIDSLRAGHTHYADVRGKQALRQAIANRHRLRSGQAVNAEQVTVLAGAQCALFCVAQCVLDPGDEVIVAEPMYVTYEGV

SEQ ID NO: 109 - DNA, 396 bp, Unknown
  Obtained from environmental sample
atgcgctacgccaagcttacccaacgcatcgccggtgacggggctgccgcctgggacatccactaccgcgccctggcgctacaggccgaaggcaaggacatcctgctgttgtcggtgggcgacccggacttcgatacccccacgccaatcgtcgaggcggccatcgacagcctgcgcgccggccacacccattacgccgatgtgcgcggcaagcaggcgctgcgccaggccatcgccaaccgccaccggctgcgcagcggccaagcggtgaaagccgagcaggtgacggtactggcaggggcgcagtgcgcgctgttctgcgtggcccagtgcgtgcttgacccgggggatgaagtgatcgttgccgaacccatgtacgtcacctacgaaggcgtg

SEQ ID NO: 110 - protein, 132 aa, Unknown; identical to SEQ ID NO: 64
  Obtained from environmental sample

SEQ ID NO: 111 - DNA, 396 bp, Unknown
  Obtained from environmental sample
atgcgctacgccaagctcacccaacgcatcgccggcgacggggctgctgcctgggacatccactaccgcgccctggcgctgcaggccgaaggcaaggacatcctgctgttgtcggtgggtgacccggacttcgatacccccacgccaatcgtcgaggcggccatcgacagcctgcgcgccggccacacccattacgccgatgtgcgcggcaagcaggcgctgcgccaggccatcgccaaccgccaccggctgcgcagtggccaagcggtgaacgccgagcaggtgacggtactggcaggtgcgcagtgcgcgctgttctgcgtggcccagtgcgtgcttgacccgggcgatgaagtgatcgttgccgaaccgatgtacgtgacctacgaagccgtg

SEQ ID NO: 112 - protein, 132 aa, Unknown
  Obtained from environmental sample
MRYAKLTQRIAGDGAAAWDIHYRALALQAEGKDILLLSVGDPDFDTPTPIVEAAIDSLRAGHTHYADVRGKQALRQAIANRHRLRSGQAVNAEQVTVLAGAQCALFCVAQCVLDPGDEVIVAEPMYVTYEAV

SEQ ID NO: 113 - DNA, 396 bp, Unknown
  Obtained from environmental sample
atgcgctacgccaagcttacccaacgcatcgccggtgacggggctgccgcctgggacatccactaccgcgccctggcgctacaggccgaaggcaaggacatcctgctgttgtcggtgggtgacccggacttcgatacccccacgccaatcgtcgaggcggccatcgacagcctgcgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgatgaagtgatcgttgccgaacccatgtacgtcacctacgaggccgtg

SEQ ID NO: 114 - protein, 132 aa, Unknown; identical to SEQ ID NO: 98
  Obtained from environmental sample

SEQ ID NO: 115 - DNA, 390 bp, Unknown
  Obtained from environmental sample
atgcgctacgccaagctcactcaacgcatcgccggcgacggggctgccgcctgggacatccactaccgcgccctggcgctgcaggccgagggcaaggacatcctgctgctgtcggtgggtgacccggacttcgacacccccgcgccgatcgtcgaggcggccatcgccagcctgcgtgcaggccacacccattacgccgatgtgcgcggcaagctggcgctgcgccaggccatcgccaagcgccaccggcagcgtagcggccaggcggtcgatgccgaccaggtgacggtgctggcgggggcgcagtgcgcgttgtactgcgtggcccagtgcctgctcgacccgggtgacgaggtgatcgtcgccgagcccatgtacgtgacttacgaa

SEQ ID NO: 116 - protein, 130 aa, Unknown
  Obtained from environmental sample
MRYAKLTQRIAGDGAAAWDIHYRALALQAEGKDILLLSVGDPDFDTPAPIVEAAIASLRAGHTHYADVRGKLALRQAIAKRHRQRSGQAVDADQVTVLAGAQCALYCVAQCLLDPGDEVIVAEPMYVTYE

SEQ ID NO: 117 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaaccgatgtacgtgacctacgagggcgtg

SEQ ID NO: 118 - protein, 132 aa, Unknown; identical to SEQ ID NO: 92
  Obtained from environmental sample

SEQ ID NO: 119 - DNA, 396 bp, Unknown; identical to SEQ ID NO: 97
  Obtained from environmental sample

SEQ ID NO: 120 - protein, 132 aa, Unknown; identical to SEQ ID NO: 98
  Obtained from environmental sample

SEQ ID NO: 121 - DNA, 396 bp, Unknown
  Obtained from environmental sample
atgcgctacgccaagcttacccaacgcatcgccggcgacggggctgccgcctgggacatccactaccgcgccctggcgctgcaggccgaaggcaaggacatcctgctgttgtcggtgggtgaccccgacttcgatacccccacgccaatcgtcgaggcggccatcgacagcctacgcgccggccacacccattacgccgatgtgcgcggcaagcaggcgctgcgccaggccatcgccgaccgccaccggctgcgcagcggccaagcggtgaaagccgagcaggtgacggtactggcaggggcgcagtgcgcgctgttctgcgtggcccagtgcgtgcttgacccgggcgacgaggtgatcgttgccgaacccatgtacgtcacctacgaaggcgtg

SEQ ID NO: 122 - protein, 132 aa, Unknown; identical to SEQ ID NO: 92
  Obtained from environmental sample

SEQ ID NO: 123 - DNA, 396 bp, Unknown
  Obtained from environmental sample
atgcgctacgccaagcttacccaacgcatcgccggcgatggggctgcggcctgggacattcactaccgcgccctggcgctacaggccgagggcaaggacatcctgctgctgtcggtgggtgacccggatttcgacacccccgcgccaattgtcgaggcagccatcgacagcctgcaggccggtcatacccattacgccgatgtacgcggcaagccggccctgcgccaggccatcgccaaccgccaccggcaacgcagcggccaggcggtcgatgccgaccatgtgaccgtgctggctggggcccagtgcgcgttgtattgcgtggcccagtgcgtgctggacccaggtgacgaggtgcttgttgccgaaccgatgtacgtcacctacgaaggcgtg

SEQ ID NO: 124 - protein, 132 aa, Unknown
  Obtained from environmental sample
MRYAKLTQRIAGDGAAAWDIHYRALALQAEGKDILLLSVGDPDFDTPAPIVEAAIDSLQAGHTHYADVRGKPALRQAIANRHRQRSGQAVDADHVTVLAGAQCALYCVAQCVLDPGDEVLVAEPMYVTYEGV

SEQ ID NO: 125 - DNA, 831 bp, Unknown
  Obtained from environmental sample
atggcggctgacgtggtctggctcaacggggccgtcgtgcccgccgccgaggcgacggtctccatcttcgaccacggcctcacggtgggcgacggcgtgttcgagacgctcaaggcgaccgccggggtgcccttcgcggcgcgccgccacctcgagcggctccggcgctccgccgacgggttggggctgaaggtgccgtggaccgacgacgacctgcgggccgcgatggaggccgtgctggccgggctcgacctgcccctggcccgggtccgcatcaccgtcaccggcggcgccgcccccctcggctccgatcgcggggacgggccgcccacggtcgtcgtggccggcgggccgctggcccggcccgcgcccaccaccgacgtctgcacggtgccgtggccccgcaacgagcgcggcgccctcgccggcctcaagaccacctcctacgccgagaacgtccgggccctggccgtcgccaaggagcagggctgcaccgaggcgctctacgccacgacgacgggcctcctctgcgagggcaccggcgccaacctcttcctcgtccacgagggccgcctcgtcacgccgacgctcgccagcggctgcctggccggggtcacccgcgccctggtcctggaggtcaccgacgccgtcgaggtcgacctgccggcggaggcgctggctggcgccagcgaggcgttcctcacgtcgacgggccgtgacgtgcaggccatcgcgcacgtcgacggccgcgcctacgacgcgccgggcccgcagacggccgcggccgcgaaggccctcgccgcgctggaggccagcaaccccgacccctag

SEQ ID NO: 126 - protein, 276 aa, Unknown
  Obtained from environmental sample
  DOMAIN (9)...(267): Aminotransferase class IV
MAADVVWLNGAVVPAAEATVSIFDHGLTVGDGVFETLKATAGVPFAARRHLERLRRSADGLGLKVPWTDDDLRAAMEAVLAGLDLPLARVRITVTGGAAPLGSDRGDGPPTVVVAGGPLARPAPTTDVCTVPWPRNERGALAGLKTTSYAENVRALAVAKEQGCTEALYATTTGLLCEGTGANLFLVHEGRLVTPTLASGCLAGVTRALVLEVTDAVEVDLPAEALAGASEAFLTSTGRDVQAIAHVDGRAYDAPGPQTAAAAKALAALEASNPDP

SEQ ID NO: 127 - DNA, 1362 bp, Unknown
  Obtained from environmental sample
atgtccgtggcgacggctcgaccgaccctgacggaacgctaccaaaccgagttcgccaactcgcgcaaactcttcgagcaggcgaagacggtattccccaacggggtcacccatgaccttcgccacctggaaccgttccccatctacgtcgaacgcgccgccggcgcctacaagtgggacgtcgatggccatcagctgatcgacttatggtccggccacggtgccctgctgctcgggcacagccatccggaaattgtcgaggcggtgcagcggcagatggcccgctcgacgcatcccggcgcctgtcatgagctggaaattgagtggggccaatgggtgcagaagctggtgccgtcggcggagcgggttcgcttcacctcatcgggcaccgaagcaaccttgatggccctgcggctggcgcgcatcttcacgggccggccgcgggtgctcaagtttgccgggcatttccacggctggcacgatttcgtcattccggccgcggacccgccctacgacggcagccccgtgcccggcgtgccgcgcgaggtggcggccgatacgctgatcgttccgcccaacgacccggccgccgtcgatcggatgttggcgagcgatccacagattggatgcgtcatcctcgaaccgacgggcggccatttcggcgcagtccctattcgtggcgagttcctgcgggcgctgcgcgaactgacgagcaagcacggccgactgctgatcttcgacgaggtcatcagcggtttccgtgtgcatccgggcggcgcccagggactctacggtgtcaaaccggacctgacgactctggccaaggtcctggccggcggattgcccggcggctgtctggcagggcgggccgacgtactcgcgggcctggagtttcgaccgggcaaaccgaagatgaagcatcccggcacgttcaacgccaatccactctcagccgcagcgggtgtgacggccctgcgcctggtagcgagcggggagccctgccggcgagcgaacgagacgggccggttgctccggaaaaacctaaacgcgctattcaccgcgcgcggcgtggactgggtggcttacggcgagttctcgggtatcaagctgctgaccggctaccagggaccgcggccgaccggtgatgatttcattccttatggcggcgccgtggacaagttggacgggcctcgaaacggcaaacttgtgcacgcgttccggcgtggaatgctactgcacggcgtggacgtgccgggacttggcggcatgacgacgacggcgcacaccgaggccgacatcgagaagacggtgggcgcggtggcgggaacgctggatctgttgcgcgaggagggcttgatgtag

SEQ ID NO: 128 - protein, 453 aa, Unknown
  Obtained from environmental sample
  DOMAIN (49)...(372): Aminotransferase class-III
  SITE (343)...(346): N-glycosylation site. Prosite id = PS00001
MSVATARPTLTERYQTEFANSRKLFEQAKTVFPNGVTHDLRHLEPFPIYVERAAGAYKWDVDGHQLIDLWSGHGALLLGHSHPEIVEAVQRQMARSTHPGACHELEIEWGQWVQKLVPSAERVRFTSSGTEATLMALRLARIFTGRPRVLKFAGHFHGWHDFVIPAADPPYDGSPVPGVPREVAADTLIVPPNDPAAVDRMLASDPQIGCVILEPTGGHFGAVPIRGEFLRALRELTSKHGRLLIFDEVISGFRVHPGGAQGLYGVKPDLTTLAKVLAGGLPGGCLAGRADVLAGLEFRPGKPKMKHPGTFNANPLSAAAGVTALRLVASGEPCRRANETGRLLRKNLNALFTARGVDWVAYGEFSGIKLLTGYQGPRPTGDDFIPYGGAVDKLDGPRNGKLVHAFRRGMLLHGVDVPGLGGMTTTAHTEADIEKTVGAVAGTLDLLREEGLM

SEQ ID NO: 129 - DNA, 864 bp, Unknown
  Obtained from environmental sample
atgcgtaccgtctatgtgaatggcaaatttctgcccgaggccgagggtatggtttcgatcttcgatcgcggcttcaccatgagcgacagtgtctacgaagtgaccggcgtcgtcgccggcaagatgctcgacttcgaccctcatatggcccgcctgcagcgctccatgagcgagctcggcatgccaaaaggccccggggccgatgccttaaaggcaattcatctgaagatgatcgagctgaacaaactcgacgaaggcctggtctatctccagattacccgcggggtgcaggaccgcaatttcgagcttcccgcagcagacaaccccttgaccatcgtgctgttcacccaggcgcgcccggtggtggaatctgcgcaggccgagcgcggcatcaaggtcatcagcctgccggatctgcgctggcaccgcagcgacatcaagacgacgcagctcctctatgcctgccttgccaaggacgcagcgaagaagcggggctgcgacgatgcctggctggtgcgcgacggtctggtgaccgagggcagcgccaacaatgccttcattgtcacgcgggacggacttgtcatcacgcgtgacctttccaccgagcttcttcccggcattacccgcaagcggatcgtcgagctggcggcaaatcacggctatcgcctcgaacaacgtgccttcaccattgccgaggcgaaggccgcggtcgaagccttcatcacctcggcaacgcagttcgtcatgccggtggtggaaatcgacggcgcggcaattggccagggcaagccaggcaaattcagtgttgcacttcgcaagctttacatcgaagaaacgctgtcgcgcgccgggatcaggcgatga

SEQ ID NO: 130 - protein, 287 aa, Unknown
  Obtained from environmental sample
  DOMAIN (7)...(276): Aminotransferase class IV
MRTVYVNGKFLPEAEGMVSIFDRGFTMSDSVYEVTGVVAGKMLDFDPHMARLQRSMSELGMPKGPGADALKAIHLKMIELNKLDEGLVYLQITRGVQDRNFELPAADNPLTIVLFTQARPVVESAQAERGIKVISLPDLRWHRSDIKTTQLLYACLAKDAAKKRGCDDAWLVRDGLVTEGSANNAFIVTRDGLVITRDLSTELLPGITRKRIVELAANHGYRLEQRAFTIAEAKAAVEAFITSATQFVMPVVEIDGAAIGQGKPGKFSVALRKLYIEETLSRAGIRR

SEQ ID NO: 131 - DNA, 855 bp, Unknown
  Obtained from environmental sample
atggcatattcattatggaatgatcaaattgtggaagaaggatccattgcggtatcaccagaagatagaggctatcaatttggtgacggcatttatgaagtaatcaaagtttataacggaaatatgtttacagcacaagagcatattgatcgtttctatgcaagcgccgaaaaaattcgtcttgttattccttatacaaaagacgttttacacaaattattacatgagctaattgaaaaaaataatctagatacagggcatgtttatttccaaatcacacgtggtgccaattcacgtaatcacgttttcccagatgcaagtgttccagctgtattaacaggtaatgtaaaagcgggtgaacgtgcatatgagaactttgaaaaaggggtaaaggctacgtttgtagaggatattcgttggttacgctgtgatattaaatcgttaaacttacttggtgcagtattagcaaaacaagaggctgctgaaaagggctgctatgaagcgattttacatcgtggggatatcgtaacagaatgctcatcagcaaatgtttatgggattaaagacggtaagctttatacacatccagcaaataacttcattttaaacggtattactcgtcaagtgattttgaaatgtgcagaggagattagtttacctgtcgtggaagaaccaatgacaaaagctgatttattaacaatggatgaaatcattgtatcatctgtatcttctgaagttacacctgttattgatgtggatggtaaccaaattggtgcaggagtgccaggtgaatggacgcgtaaattgcaacaagcttttgaggcgaaattaccactttctttgaatacaaaataa

SEQ ID NO: 132 - protein, 284 aa, Unknown
  Obtained from environmental sample
  DOMAIN (7)...(274): Aminotransferase class IV
MAYSLWNDQIVEEGSIAVSPEDRGYQFGDGIYEVIKVYNGNMFTAQEHIDRFYASAEKIRLVIPYTKDVLHKLLHELIEKNNLDTGHVYFQITRGANSRNHVFPDASVPAVLTGNVKAGERAYENFEKGVKATFVEDIRWLRCDIKSLNLLGAVLAKQEAAEKGCYEAILHRGDIVTECSSANVYGIKDGKLYTHPANNFILNGITRQVILKCAEEISLPVVEEPMTKADLLTMDEIIVSSVSSEVTPVIDVDGNQIGAGVPGEWTRKLQQAFEAKLPLSLNTK

SEQ ID NO: 133 - DNA, 876 bp, Unknown
  Obtained from environmental sample
atgagcggaccgctcccgatctgctacctgaacggcgagttcttgccgttgcgcgacgcccgtgtatcgcccttggaccgcgccttcctgttcggcgatgcggtgtacgaggtggtgccggtctacgatgcgcgcccgttccggctgcgccagcacctggagcgcctcgaccgcagcctcgccggcatccgcatgccgccggccctgccgcacggcgactgggcacacatctgccaggagctgatccgccgcaacgacgccgacgaggcctacgtatacatgcaggtgagccgcggtgcggagtatggccgcaatcacgcctggcccgaggacttgaagcccaccctgttcgcctatatttcggcgatggacgggctctcgaacgccctcatcgagaagggcgtggccgcggtgaccgccaaggaaatccgctgggcgcgtcgcgacatcaagtcgaccgcgctattgggcaatattctcttgaagaagctggcgcaggagcgcggcgccttcgagaccatcatgctggagaacggcgaattgaccgagggctcatccaccaccgtgcacgtgatcaagaacggcatcattcacacgccgccgaacggccagaagatactgcccggcaccacgcgcgatgtggtgaccgagcttgccgggttgctgtccatcccctgcaagagcgcgccggtgagcgaagcggagctgcgcgcagcggacgagatctggctcgcctttgccacccgcggggtgcttgccgtgacggcgcttgacggcgagccggtgggcggcggcaaaccgggtccgctgttcgctcgcatgcgactcgcgttcgccaactatgcacgcgacctcaagggcagtccggcgctatga

SEQ ID NO: 134 - protein, 291 aa, Unknown
  Obtained from environmental sample
  DOMAIN (11)...(279): Aminotransferase class IV
MSGPLPICYLNGEFLPLRDARVSPLDRAFLFGDAVYEVVPVYDARPFRLRQHLERLDRSLAGIRMPPALPHGDWAHICQELIRRNDADEAYVYMQVSRGAEYGRNHAWPEDLKPTLFAYISAMDGLSNALIEKGVAAVTAKEIRWARRDIKSTALLGNILLKKLAQERGAFETIMLENGELTEGSSTTVHVIKNGIIHTPPNGQKILPGTTRDVVTELAGLLSIPCKSAPVSEAELRAADEIWLAFATRGVLAVTALDGEPVGGGKPGPLFARMRLAFANYARDLKGSPAL

SEQ ID NO: 135 - DNA, 864 bp, Unknown; identical to SEQ ID NO: 129
  Obtained from environmental sample

SEQ ID NO: 136 - protein, 287 aa, Unknown; identical to SEQ ID NO: 130
  Obtained from environmental sample
  DOMAIN (7)...(276): Aminotransferase class IV

SEQ ID NO: 137 - DNA, 1386 bp, Unknown
  Obtained from environmental sample
atgcctgacaccaacctgacgaactcgaagatcgtcgcggcctatcgcgagcgcacaccgggctcagcgagccttgcggccaaggcgcaggagctgctgccgagcggcatcgcccacgacgcccgcttcatgaagccctacggcatctatgtcgagcgagccaagggcccgcgcaaatgggacgtggacggcaacgagtacgtcgactatttcggcggacacggcgcgttgctcctcgggcacaaccatccgagcgttgtggccgcgagccacgcggcgctcgagcaaggcacgcatttcggcgccaatcatccgcgcgaggtccgctgggccgaactggtgcgcaagctggtcccctcggcggagagcgtgcgcttcacctcgtccgggaccgaggccacgttgatggcggtgcggctttcgcgctcggtcaccggcaagcccaaagtcgtgcgcttcctgacgcatttccacggctggcacgaccacatgacctcgggccacgccaaccatttcgacggcacgccgacggcgggcgtgctggccggcgtcgccgagcacgtgatcctgctgccgcctggcgacgtcgaagcggtaaagagcacgttcgccagccgcaacgacatcgcctgcgtgatcctggagccgaccggcacgagcttcggcgcggcgccgctgccgccgtccttcctccgcgtcctgcgcgaggagaccgagaagcacgggatcttcctgatcttcgacgaggtggtgacgggatttcgcgtctcgcccggcggcgcgcaaggcgagttcggcatcaagcccgacctgacgtcgctcgccaagatcctggcgggcggattgcccggcggcgcggtcgtgggccggcgcgacattctggacgacctcgacttcgacgcggtcgagcgcaagaagcgcgagaagatcgcgcaccccggcacctacaatgctaatccgctatccgccgccgccggcatcgccgcgctggagatcgtcggcaccggcgagccctgcaagcgggccagcgccacggccgcctcgctccgcgcggcgctcaacgacgtactggcggaggagcgcgtaccttgggcggtctacggctccttcagcggattccatttcttcctgaatgcgaagcagcgggcggtcgacccgttgcgcttcgatccgatgacgctcgactacaaagagctgctgagcaatccacccgcgctcgcgcgcttgctgcgcctggcgctcctcgccaacggcgtcgacgtcaacggccgggcaagcggcttcacctccgcggcgcatgggcctgcggagatcgaggaaaccgcccgtgcgctccgccagagtctccgcatgctgcgcgccgagggcgagctgccggctcgataa

SEQ ID NO: 138 - protein, 461 aa, Unknown
  Obtained from environmental sample
  DOMAIN (50)...(377): Aminotransferase class-III
  SITE (5)...(8): N-glycosylation site. Prosite id = PS00001
MPDTNLTNSKIVAAYRERTPGSASLAAKAQELLPSGIAHDARFMKPYGIYVERAKGPRKWDVDGNEYVDYFGGHGALLLGHNHPSVVAASHAALEQGTHFGANHPREVRWAELVRKLVPSAESVRFTSSGTEATLMAVRLSRSVTGKPKVVRFLTHFHGWHDHMTSGHANHFDGTPTAGVLAGVAEHVILLPPGDVEAVKSTFASRNDIACVILEPTGTSFGAAPLPPSFLRVLREETEKHGIFLIFDEVVTGFRVSPGGAQGEFGIKPDLTSLAKILAGGLPGGAVVGRRDILDDLDFDAVERKKREKIAHPGTYNANPLSAAAGIAALEIVGTGEPCKRASATAASLRAALNDVLAEERVPWAVYGSFSGFHFFLNAKQRAVDPLRFDPMTLDYKELLSNPPALARLLRLALLANGVDVNGRASGFTSAAHGPAEIEETARALRQSLRMLRAEGELPAR

SEQ ID NO: 139 - DNA, 1383 bp, Unknown
  Obtained from environmental sample
atgcccgatacgctgacgacaaactcgccgatcatctccgcctaccgcgccgcgacacccggctcggccgagcacgcgcaacgcgccgccgagatgttcccctccggcatcacccacgattcgcgctacatcgagccctacgggatctacattgcgcgcgcccaggggccgcgcaaatgggatgtcgacgggcgctgctatgtcgattatttcggcggccatggtgcgctgctgctcggccattgccatcccgaagtgatggcggcggtacacgcccaactcgaccgcgggacccattacggcgccagccacgagctggagatcgaatgggccgagcgggtcaaggcgctgatcccgaccgccgagcgcgtgcgtttcacctcatcgggcaccgaggcgacgctgatggcggtgcgcctcgcgcgcgccttcaccggcaagccgaagctgatccgcttcaactaccatttccacggctggcacgaccacatgacgtccggccacgcgaaccatttcgacgggacgccgacgaccggcgtgctcgacgcggtggccggcaacgtccttctgtgcgaccagaatgacgaggcggcgctggcgcggctgctcgaccggcatcacggcgagatcgccgcggcgatcatcgagccgactggcgccaacggcggcaaattgccgatcgacccggatttcctccaggcgctgcgccggctcaccagcgagcatggcgtgctgttgatctttgacgaggtggtgaacggtttccgggtcgcgccaggcggcgcgcaggaggcctacggcatccggcccgatctcacaaccctggcgaaaatcctcgccggcggactgccgggcggcgccgtaaccggcagaaaggacatcctcgacctcctcgacttccaggttaccaaaggcgccggcaaggagaagatcaaccatcccggcacattcaacgccaacccgctgtcggccgccgccgggattgccgccctcaagatcgtgcgcgagagcgacgcctgcgcccgcgccaaccattacggcgacgagctgcgccgccggctcaacgaggtgtttgaggaggagcggatgccgtgggccgcgtacggcaccttctcgacccttgaattgttcaccaaccccgagggcaaaaagatctcgccgagcaccttcgatccgctagaggaatcgttcgccagcctcaaaggcgagcgcaacgccggcatcatccacaagctgcgcctcggcatgatgatccacggcgtcgacttgtcgagccatccgggcggcgtcatctcgtgcacgcacggcgaagccgagatggaggacaccgtcaaggcgatgcgaagcaccgtgcgcatgctgcgcgccgagggtgagctgtag

SEQ ID NO: 140 - protein, 460 aa, Unknown
  Obtained from environmental sample
  DOMAIN (50)...(378): Aminotransferase class-III
MPDTLTTNSPIISAYRAATPGSAEHAQRAAEMFPSGITHDSRYIEPYGIYIARAQGPRKWDVDGRCYVDYFGGHGALLLGHCHPEVMAAVHAQLDRGTHYGASHELEIEWAERVKALIPTAERVRFTSSGTEATLMAVRLARAFTGKPKLIRFNYHFHGWHDHMTSGHANHFDGTPTTGVLDAVAGNVLLCDQNDEAALARLLDRHHGEIAAAIIEPTGANGGKLPIDPDFLQALRRLTSEHGVLLIFDEVVNGFRVAPGGAQEAYGIRPDLTTLAKILAGGLPGGAVTGRKDILDLLDFQVTKGAGKEKINHPGTFNANPLSAAAGIAALKIVRESDACARANHYGDELRRRLNEVFEEERMPWAAYGTFSTLELFTNPEGKKISPSTFDPLEESFASLKGERNAGIIHKLRLGMMIHGVDLSSHPGGVISCTHGEAEMEDTVKAMRSTVRMLRAEGEL

SEQ ID NO: 141 - DNA, 855 bp, Unknown
  Obtained from environmental sample
atgacgcgtattgtttatttaaatggtgaatacctgccggacagtgaagcgaaaatttcgatttttgaccgcgccgtgaccttcggcgacgccatctacgatgtcgccggagtgctcgacggcaagctggtcgacttcgagcaccacatgcagcgctacttcaactcgctgcgcaaactggggatcgagtcaccgttgagccaggacgaaatcctcgctgcgtttcgcgaactggtggcgaagaacgaattggacgaaggtctggtgtacatgcaggtcacccgaggcaccgccgagcgcgatttcgactggccggaaggaatccagcccaacgtgttcatgttcacccaggtcaaggactcgatggaaaacgaggcagccgagactggcgtcgggctcgcgtccaccgacgatatccgctgggcccgccgcgatatcaagtcggtcaacctgctcgggcaggtgctggccaagcacaaggcgcacgaggccggcgcctacgaggcgctgatgatcgaccgcgagggttacgtgaccgaatgcggcagcaccagttttttcatcgtgcgtgacaggcgtatcctgacccgaccgctgagcaacgacattctgcccggcgtcacgcgccgcgcgctggttgcgctgtgcgaacgcgattcgctcgacctggaggaatgccgatttaccctcgaagacgcgctgggtgccgacgaggccttcatcagcggggcatcgagttacgtgctaccggtaaaagaaatcgacggtcagaagatcggcagcgaaatgccgggaccagtcacccgccacatgcgcgagatctatctcgacttcgtccgcgccagcctgatctag

SEQ ID NO: 142 - protein, 284 aa, Unknown
  Obtained from environmental sample
  DOMAIN (8)...(276): Aminotransferase class IV
MTRIVYLNGEYLPDSEAKISIFDRAVTFGDAIYDVAGVLDGKLVDFEHHMQRYFNSLRKLGIESPLSQDEILAAFRELVAKNELDEGLVYMQVTRGTAERDFDWPEGIQPNVFMFTQVKDSMENEAAETGVGLASTDDIRWARRDIKSVNLLGQVLAKHKAHEAGAYEALMIDREGYVTECGSTSFFIVRDRRILTRPLSNDILPGVTRRALVALCERDSLDLEECRFTLEDALGADEAFISGASSYVLPVKEIDGQKIGSEMPGPVTRHMREIYLDFVRASLI

SEQ ID NO: 143 - DNA, 915 bp, Unknown
  Obtained from environmental sample
atgaaaggaaatactaatgccgacctttcctcagtggatctgcccggggcaggttctacagccgtgtatcctaccaaggtatttctgaatggcagcatagtcgatgctgaaaacgcaaaggtttccgtctttgatcggggttttatctttggcgacgggatctatgaagtaatggcccggatcaatggcgttttcttctatggcgatgcccattgggaacgattggaaacctgcctgcagaagatcggcctggtctacgacatatcaattctaaaggacgcgatcccggaattgctggaagcatccggaataggtcaggaagattgtatggtctatatccaggtaaccaggggaacggcccccaggcagcatggctaccctcccagcccccaacccactgcaatgatgtacgcctggaagaagaccctcccggccattgaaacaaagcattcccgtgtagttaccctggaggattttcgttggtctcgctgcgatattaaaatgacgtccctcttgggcaatgtcatggcaaacgaatgggccatggagaacgaggcctacgaaaccgtcctgatccgaaatggcgtagccacagaggcatcccactgtaatgttttcttcgtgaaggacggtacggtatggacccaccctgcggaccatcatatcctcgacgggatcacacgccaggtagtcctggaaatttgtgaggagctcggcatcccggttagacttgagggtataccggcggataaattgaaacaaatggacgaggccttccttacgggcaccggatcacaggtacgggccatacaggagctcgacgaccatccgtattttaaaacccatccgggtcctgtaacccttcggatacaacgcacattcctagaacttaaaagcggaaagatctcgttctga

SEQ ID NO: 144 - protein, 304 aa, Unknown
  Obtained from environmental sample
  DOMAIN (30)...(295): Aminotransferase class IV
  SITE (30)...(33): N-glycosylation site. Prosite id = PS00001
  SITE (202)...(231): Aminotransferases class-IV signature. Prosite id = PS00770
MKGNTNADLSSVDLPGAGSTAVYPTKVFLNGSIVDAENAKVSVFDRGFIFGDGIYEVMARINGVFFYGDAHWERLETCLQKIGLVYDISILKDAIPELLEASGIGQEDCMVYIQVTRGTAPRQHGYPPSPQPTAMMYAWKKTLPAIETKHSRVVTLEDFRWSRCDIKMTSLLGNVMANEWAMENEAYETVLIRNGVATEASHCNVFFVKDGTVWTHPADHHILDGITRQVVLEICEELGIPVRLEGIPADKLKQMDEAFLTGTGSQVRAIQELDDHPYFKTHPGPVTLRIQRTFLELKSGKISF

SEQ ID NO: 145 - DNA, 1350 bp, Unknown
  Obtained from environmental sample
atggctctcgaacaggtctatcgtcaagcgcttccggcctcgcacgccctctttgagcgcgcccaaaaccttttccccgacggggtcacccacgacaaccgccggatgcagccttttcccatctttgtcgaacgtgccgatggggcgtacaaatgggatgccgatggccggcagtatatcgactactggatgggccatggtgcactcattatggggcataaccctccgcacgtgcgcgatgccgtcatcgagcaagcggcgcgtggcacgcactacggcgccagtcatgctctcgaagtggtatgggccgaatgggtctgtaagctggtgccctgtgctgagcgcgtgcgctttacggcctcgggcactgaggcgacgcacatggccctgcgtctggcccgcgcctatacgggcaagcggcgcgtgatcaaattcgccgggcactttcacggctggcatgagggcctggaagtgggtgtacagaccccctatgaaacagtgccagagccagggcaaatgcaagaagcggtagacgccgtcgccctgtgcccaccgaacgacattgaggccgtccgggctgcccttgccgctggtgacgtggccgctattatcctcgaacccacgggtggccactttggcacggtgccggtggcgccgggttttttacggtgtctacgggaagaagccaccagggctggggtggtgctcatcttcgacgaagtagtgacgggttttcgtgttgcgccaggcggtgcacaggaactctacggcgtcactcctgacctttcgacgtttgctaaaattctcgctggcggtctgcctggtggggctgttgctggccgggccgagatttttaactatctggcgacgccaacagccgctgagataggaaaacgtgcaaagattcaccatcccggcacgttcaacgccaatcccctctcggccgcggccggcgtggcgatgctgtcctctctggccgatggcacatgcatcaagcgcgccaacgagcaggctgccaagctacggcatggtatgaacgacatcctcgcacgcgaaaaagtcgcctggaaagtctatggccagcacagcgactggaaactgttctacggcgctggtgccccaccgcgtgatggcgctgaccagtccgtggatgacatcccctggcagcgcctggacggcaaattcccgcagcagagccgggccatgcggcaagcgctcatcctgcaaggtattgactttaacggggcgcgtgctctcgtaggtacctgccacactgacgacgtcgtcgctgagaccctggcgggctttgcagaggcggtacgggccgtcaaagccgacgggctcgcgtaa

SEQ ID NO: 146 - protein, 449 aa, Unknown
  Obtained from environmental sample
  DOMAIN (42)...(355): Aminotransferase class-III
MALEQVYRQALPASHALFERAQNLFPDGVTHDNRRMQPFPIFVERADGAYKWDADGRQYIDYWMGHGALIMGHNPPHVRDAVIEQAARGTHYGASHALEVVWAEWVCKLVPCAERVRFTASGTEATHMALRLARAYTGKRRVIKFAGHFHGWHEGLEVGVQTPYETVPEPGQMQEAVDAVALCPPNDIEAVRAALAAGDVAAIILEPTGGHFGTVPVAPGFLRCLREEATRAGVVLIFDEVVTGFRVAPGGAQELYGVTPDLSTFAKILAGGLPGGAVAGRAEIFNYLATPTAAEIGKRAKIHHPGTFNANPLSAAAGVAMLSSLADGTCIKRANEQAAKLRHGMNDILAREKVAWKVYGQHSDWKLFYGAGAPPRDGADQSVDDIPWQRLDGKFPQQSRAMRQALILQGIDFNGARALVGTCHTDDVVAETLAGFAEAVRAVKADGLA

SEQ ID NO: 147 - DNA, 1383 bp, Unknown
  Obtained from environmental sample
atggcgcaagctctcgtgacaacgacgatccaccaggactatgaaacgcggttcgctgactcgcgcgcgatgcacgagcgcgcgcggcagctcatccccggcggcatcacccacgatggccgtttcctgaagccgtttccgccctacatcgccgacgcgcaaggcgcgtacaagtggagcgtcgacggtaacaagctgatcgacttcgccatggggcacggctcgctcctctttgggcacaacgatcccgacatcgtggcggcgatgcaggcgcagctcccgcacggcacgcactacagtgccggtcacgagctggaggtgcgctgggcggaggagatcagccggctcgtcccgtccgcagagcaagtgaaattcacgggctccggcaccgaagcgacgctgctagcgatccgtgtcgcgcggtcgttcactggccgcgagacggtcgtcaagctggaaggacatttccatggctggcatgactacctcctgaaaggagagcggccgccgttcgagtcgccatccagtcccggcatcccctccgccgtgacggcgaccgtcgccgtcgttccttcagacgatctcgggatgctcgaggagcggttggcgcaaggcgatgtcgcggcgctgatcatggagccgagcggtggctcctgggcgacgatccccttccccgaagaatatctgcaggcggcgcgcgacctggccacgcgttatggggtcgtactcatcttcgacgaggtgatcaccggcttccgctgggcgcctggtggtgcgcaggagcgcttcggcgtcatcccggacctcacgaccatggccaagatcgttgccggcggcatgcccggcggtgcgctgggaggccggcgcgacatcatggaggtgctggcgttcaaggatgacgcgacgtggaacgcgacgaagaaggtccgccaccaggggacctacaacgccagcccggtcgtctgtgcggcggcgatcacctgcctgcggaaagcggccgatccatccgtacagcgctactgcgacgacctcgcggcgcggctgcgcgccggtctcaatgcggctctgatggagcgtgacgtgccaggcttctcctggggcgagagctccatcttccacgttgcgctcggggagcgcgcaccgaaccagagcggaggcgacatgcgctcaccgtccggcattgcggcagagacgctcaagtcgagcgtgcgcaccccgctcaaccagacgctccacctcgggatgcttttggcaggagtggatttcttcgccggcggtgggctgctcggccgcgcccacaccgcgcaggacatcgacgactcgatcgccgccttcggccgcgtgctcgaccgcatgcgggatgagggagcgttcgcggcgtag

SEQ ID NO: 148 - protein, 460 aa, Unknown
  Obtained from environmental sample
  DOMAIN (49)...(375): Aminotransferase class-III
  SITE (308)...(311): N-glycosylation site. Prosite id = PS00001
  SITE (387)...(390): N-glycosylation site. Prosite id = PS00001
  SITE (414)...(417): N-glycosylation site. Prosite id = PS00001
MAQALVTTTIHQDYETRFADSRAMHERARQLIPGGITHDGRFLKPFPPYIADAQGAYKWSVDGNKLIDFAMGHGSLLFGHNDPDIVAAMQAQLPHGTHYSAGHELEVRWAEEISRLVPSAEQVKFTGSGTEATLLAIRVARSFTGRETVVKLEGHFHGWHDYLLKGERPPFESPSSPGIPSAVTATVAVVPSDDLGMLEERLAQGDVAALIMEPSGGSWATIPFPEEYLQAARDLATRYGVVLIFDEVITGFRWAPGGAQERFGVIPDLTTMAKIVAGGMPGGALGGRRDIMEVLAFKDDATWNATKKVRHQGTYNASPVVCAAAITCLRKAADPSVQRYCDDLAARLRAGLNAALMERDVPGFSWGESSIFHVALGERAPNQSGGDMRSPSGIAAETLKSSVRTPLNQTLHLGMLLAGVDFFAGGGLLGRAHTAQDIDDSIAAFGRVLDRMRDEGAFAA

SEQ ID NO: 149 - DNA, 1377 bp, Unknown
  Obtained from environmental sample
atgccacaaccaaccaatcccaacccactcgaaaccgcctacacacaaactctcccaaattcccgggcgctctttgagcgcgccagcaagctctttcccgatggggtgacacacgacaatcgacgcatgcagccctttcctatctttgtggatcgtgctgatggtgcccataagtgggacatcgacggccgttgttacattgactactggatggggcacggtgcactcctcttcgggcataacccgccgcacgtccgcgacgcggtgctcgaacaagtgtcgcgtggtacacactatggtgccagccaccccctggaagtcgcctggggtgaatggatttgtcgtctggtgccctgcgccgagcgtgtacgctttaccgcctcaggcaccgaagccacccacatggcggtgcgtctggcgcgggcgtttaccggtaaaaagcgtgtgatcaaattcgccggccattttcacggctggcacgaaggtctggaagtcggcgtgcaagccccctatgagacattcccagaagctggccaactgcccgcagtggtggatgtcgtagccctgtgcccacccaacgatattgccgcggtacgggcggcactggccgctggggacgtggcagcagtaattctcgaacccaccgggggccacttcggcgccgtgccagtgacaccaggatttctggcccagctccacgacgagacgcgcaaaaccggtactgtgctgatcttcgacgaggtggtaacaggttttcgtgtagctcccggtggggcacaagaactctttggggtcacaccagacctggctacctttgccaagattcttgctggtgggctgcctggcggcgccgttgctggccgcgcagagatcatggcctacctggcgaccaaagccacaccggaggaaacccaccgtaccaaaatgccccatcctggcacattcaacgccaaccctttatcagccgccgcaggcgtggccatgctggcatcagtcgcggatggcacagccatccgcctggcgaacgcacaggcggccaagctcaggcacggcatgaacgagattctggcacgggaacaagtggcatggaaggtctatggccagcacagcgactggaaagtctactatggggctgacgccccaccacgtgatggcaatgaccaagcggtggacaacattccctggcagcgcctcgatgccaggtatcccgtgcagagccgggtactgcgacaggccatgatccttcagggaattgattttaacggcgcacgggctctagtgggtacttgccacacggacgacgtcatcgcccacaccctggagggctttgccgcggccatccgtgccgtgaaagctgcggagtcccacaggtactag

SEQ ID NO: 150 - protein, 458 aa, Unknown
  Obtained from environmental sample
  DOMAIN (49)...(367): Aminotransferase class-III
MPQPTNPNPLETAYTQTLPNSRALFERASKLFPDGVTHDNRRMQPFPIFVDRADGAHKWDIDGRCYIDYWMGHGALLFGHNPPHVRDAVLEQVSRGTHYGASHPLEVAWGEWICRLVPCAERVRFTASGTEATHMAVRLARAFTGKKRVIKFAGHFHGWHEGLEVGVQAPYETFPEAGQLPAVVDVVALCPPNDIAAVRAALAAGDVAAVILEPTGGHFGAVPVTPGFLAQLHDETRKTGTVLIFDEVVTGFRVAPGGAQELFGVTPDLATFAKILAGGLPGGAVAGRAEIMAYLATKATPEETHRTKMPHPGTFNANPLSAAAGVAMLASVADGTAIRLANAQAAKLRHGMNEILAREQVAWKVYGQHSDWKVYYGADAPPRDGNDQAVDNIPWQRLDARYPVQSRVLRQAMILQGIDFNGARALVGTCHTDDVIAHTLEGFAAAIRAVKAAESHRY

SEQ ID NO: 151 - DNA, 852 bp, Unknown
  Obtained from environmental sample
atgtccgaaattgttttcctgaacggaaggttcatctctaaaaatgaagcggttatttctcctgaagaccgtggttttaactttgccgacggcatttacgaagtcgtgaaatactacaacggaaggccttttcgatatgccgaccacatggaacgcctgcgccggagccttcgcgaagtgcaaatcgggttcaacggtaccgatctgctggaagccatttttcaggagctactgagacggaacgaccttgaacaacaggaagccggcatttacctgcagattacacgtggagctcatcagcgcatgcaccggtatcccgacaacattgaaccaactgtttatgccaccgcgttttcgtttgcgtccaaccgcgaacaacttgggtgcggcgtgaaagtgatcactactgaagatgtgcgttggcttcgctgcgacatcaaatcggtttcactgctgcccaacgcgatggcggcacagaaagcatacgaaaacgatgccgccgaagctatttttatccgcaatggtgtggtcactgaagggtcgcattccagttttatggccgtgaaaaacaatgttgtttatacacatccagactcgaacctgattttgccgggcatcacaaaaatggtagttcgggaaatttgccgcacccatcggatcgagctggtggaagaagcaattcaggcttcacagctttctgaaatggacgaaatgatgatcgtgggaaccggaagcgaagtaatgccggtagtgcagttcgaccaaataatggtgggcaatggccaacccggaccgataacacttcaacttcaggagaaattttttgaattgaccaaacaaacaaattcatag

SEQ ID NO: 152 - protein, 283 aa, Unknown
  Obtained from environmental sample
  DOMAIN (8)...(275): Aminotransferase class IV
MSEIVFLNGRFISKNEAVISPEDRGFNFADGIYEVVKYYNGRPFRYADHMERLRRSLREVQIGFNGTDLLEAIFQELLRRNDLEQQEAGIYLQITRGAHQRMHRYPDNIEPTVYATAFSFASNREQLGCGVKVITTEDVRWLRCDIKSVSLLPNAMAAQKAYENDAAEAIFIRNGVVTEGSHSSFMAVKNNVVYTHPDSNLILPGITKMVVREICRTHRIELVEEAIQASQLSEMDEMMIVGTGSEVMPVVQFDQIMVGNGQPGPITLQLQEKFFELTKQTNS

SEQ ID NO: 153 - DNA, 1269 bp, Unknown
  Obtained from environmental sample
atggaaatcgatcaggagatgtacgagcgcatggccggctcggccgcgctctacgagcgggcgaaggagacgtttcccagcggcgtcacccatgacgcccggtacgccaagccgttcccgatctacgtcacccgtgcccagggcagccgcaaatgggacgtcgatgggaacgagtacgtcgactactacggtggccacggcgcactgatcctcggacactgccacccggtcgtgacccaggccgtcgtcgagcaggctcagaaggggagccattacggcgcctgccacgagctcgagatccgctggggcgagctggtccaggagatcgttccttcggctgaggcggtcaagttcgtctcgtccggcaccgaggcgacgatgctggcgctgcggctggcccgggcgttcactggccgcgatcggatcatcaaggcgaacgggcacttccacggctggcacgactacgcggcggtggcaatggccccgccctgggacgtgccgatctcggtgggcatcccgaagggcgtccagggcacggtgactggcatcgacgacaaggacgccgatgcgctggaggccgagctggcgaagggcgacgtcgcggcggtcatcatctggtgcaacgccctcaacaaggagtgggccgagacggtccgcgacaaggcgaaggcgcacggcgccctcgtgatctacgacgaagtcgtgacgggcttccgctacgctccagggggcgcgcaggagtacttcggcgtcaagccggacctgacgacgctggcgaagatcgttgctggcgggtacccgggcggcgccattgccgggcgggatgacatcatccaccagttcgacttctcggacgatccgaagaagcagcggttcgctcggatcgcccaccccggcacctacaacgccagcccggtctcggcggcagcgggcgtggcctgcctggagatcgtcaaggacccggcgattcagcagaaggcggccgacaccgcgacgaagatcaaggctggtttcaaggaggcgctcgaccggaccggcgtcgagggctcagtgaccggctgggcatcgtatatctcgaccagcctgaaggggaaggggagcgcctggtcgctccagctcaagtggcgggcggcgatgcagcttggcggcgtcgatccgtccggcaccagcctgatcgtctcggcgatgcacgacgacgaggatgtcgagcggaccgtggccgcgtacgaggcggcgatccaccggctgcgcaacgaaaacctgatctag

SEQ ID NO: 154 - protein, 422 aa, Unknown
  Obtained from environmental sample
  DOMAIN (42)...(364): Aminotransferase class-III
MEIDQEMYERMAGSAALYERAKETFPSGVTHDARYAKPFPIYVTRAQGSRKWDVDGNEYVDYYGGHGALILGHCHPVVTQAVVEQAQKGSHYGACHELEIRWGELVQEIVPSAEAVKFVSSGTEATMLALRLARAFTGRDRIIKANGHFHGWHDYAAVAMAPPWDVPISVGIPKGVQGTVTGIDDKDADALEAELAKGDVAAVIIWCNALNKEWAETVRDKAKAHGALVIYDEVVTGFRYAPGGAQEYFGVKPDLTTLAKIVAGGYPGGAIAGRDDIIHQFDFSDDPKKQRFARIAHPGTYNASPVSAAAGVACLEIVKDPAIQQKAADTATKIKAGFKEALDRTGVEGSVTGWASYISTSLKGKGSAWSLQLKWRAAMQLGGVDPSGTSLIVSAMHDDEDVERTVAAYEAAIHRLRNENLI

SEQ ID NO: 155 - DNA, 1362 bp, Unknown
  Obtained from environmental sample
aagaattcgccgatcatcgccgcctaccgtgccgcgaccccgggctcggccgccgccgccgagaaggcgagccgactgttccccagcgggatcacccatgattcccgctatatcgagccctacgggctctacatcacccgcgctcaggggccgcgcaaatgggacgtcgacggcaactgctatgtcgactatttcggcggccatggggcattgctgctcgggcacggccacccgaaggtggtcgaggcggtgcagcggcagatcgagcgcggcactcattacggcgccagtcacgaaaccgagatcgcctgggccgaatgggtcatgaagctgatcccgtcggccgagcgggtgcgcttcacgtcctcgggcaccgaggcgacgatgatggcggtgcggctcgcccgcgccttcaccggcaaatccaaattcatccgcttcaagcaccatttccacggctggcacgaccacatgacctcgggctatgcgagccactttgacggcagcccgacccctggtgtgctgccggggatcactggcggcctgttgctggccgagcagaacgacgccgaagggctggcccgcctgctggaggccaatgacgatgtcgccgcggcgatcctcgagccgaccggcgcccacggggcgcagctgccgatcgacccaaaattcctggtcgcgctgcgcgagctgacgcggcagcacggtgtcgtgctgatcttcgacgaggtggtgaccggtttccgggtttccccaggcggggcgcaggccgaatacgggattcgcccggacttgacgaccttggccaagatccttgccggcgggttgccgggcggcgcggtcgccggccgcaaggacatcctcgacctcctcgacttccagatcaccaaggccgccgaccgcgagaagatcacccatcagggcaccttcaacgccaacccgctgtcggccgctgccggggtcgcggcgctcgaaatcgtcggcacgaccgacgcctgcgcggccgccaaccgctacgccgacacgatgcggcgccggatcaacgaggtgttcgaggaagagcacgtgccatgggcggcctacggcatgttctccaacttccatttcttcaccaaccccgaccgccggacgatcgtcccgacccgcttcgacccgctcgagcagccgccggcggcgctcaccggcaagagccaggcgggcctggtccacaaattccggctggcgatgatgacggccggggtcgatttcagcggtagccccggcggcgtcatctccgccacccacggcgacgctgagctcgaagacacgctgaaagcgctgcgcagcaccctccggatgctgcgtcaggagggcgagctttaa

SEQ ID NO: 156 - protein, 453 aa, Unknown
  Obtained from environmental sample
  SIGNAL (1)...(19)
  DOMAIN (44)...(371): Aminotransferase class-III
KNSPIIAAYRAATPGSAAAAEKASRLFPSGITHDSRYIEPYGLYITRAQGPRKWDVDGNCYVDYFGGHGALLLGHGHPKVVEAVQRQIERGTHYGASHETEIAWAEWVMKLIPSAERVRFTSSGTEATMMAVRLARAFTGKSKFIRFKHHFHGWHDHMTSGYASHFDGSPTPGVLPGITGGLLLAEQNDAEGLARLLEANDDVAAAILEPTGAHGAQLPIDPKFLVALRELTRQHGVVLIFDEVVTGFRVSPGGAQAEYGIRPDLTTLAKILAGGLPGGAVAGRKDILDLLDFQITKAADREKITHQGTFNANPLSAAAGVAALEIVGTTDACAAANRYADTMRRRINEVFEEEHVPWAAYGMFSNFHFFTNPDRRTIVPTRFDPLEQPPAALTGKSQAGLVHKFRLAMMTAGVDFSGSPGGVISATHGDAELEDTLKALRSTLRMLRQEGEL

SEQ ID NO: 157 - DNA, 879 bp, Unknown
  Obtained from environmental sample
atgagcgatcgcgttcctgagcatctaagaggctggaccgtttatctgaacggcaaatatctgtcaggcgccgaggcgtcggtgtcggtcttcgatcgcgggtttctgatgagcgatgcggtttacgagatgaccgcagtactggatggaaagctgatcgaattccccggacatatggcgcggttgagacggtcattgcgcgcgcttgagatcccattcgaactggatgaaagcgctgttttgaagatgcaccgcgaactgctacgccgaaatgcggtcaccgatggcatgctctatgtccaaatctcgcgtggtgtggccgagcgtgactttgccttcccggaaggtatcgagccgacggttttcgcctttgtcaaagacctcgacctgttgaagatgcccgcaatagaaaccgggttccgcgtcatctcgtatccagaaggacgttgggcgcggcgggatgtgaaatcgacccagatgctgtggaccagcatcggaaagaccgcggctctgcgcgcgggcgtcgatgatgtgttttttgtcgaggacggatatgtgactgaagcgtcggcctgcaatgccttcatcatcaaagacggcgttatgagatctcgcgcgctgagccaaagcatcctgcacgggatcacccgtgctgtcattgtccgcttcgctcggatcgccgggctggcgcttgacgaaaccccgttcactattgacgaggcgaaggcggcggatgaggtctttgtcaccgcctcgcctcttttcgcgattggcgttgttgaggtggatggacagatgatcggcgacggtaggccggggccgaagacaatgcagcttcggcagttgcatatcgaggagagtctgaaaaccgcgctctga

SEQ ID NO: 158 - protein, 292 aa, Unknown
  Obtained from environmental sample
  DOMAIN (17)...(284): Aminotransferase class IV
MSDRVPEHLRGWTVYLNGKYLSGAEASVSVFDRGFLMSDAVYEMTAVLDGKLIEFPGHMARLRRSLRALEIPFELDESAVLKMHRELLRRNAVTDGMLYVQISRGVAERDFAFPEGIEPTVFAFVKDLDLLKMPAIETGFRVISYPEGRWARRDVKSTQMLWTSIGKTAALRAGVDDVFFVEDGYVTEASACNAFIIKDGVMRSRALSQSILHGITRAVIVRFARIAGLALDETPFTIDEAKAADEVFVTASPLFAIGVVEVDGQMIGDGRPGPKTMQLRQLHIEESLKTAL

SEQ ID NO: 159 - DNA, 822 bp, Unknown
  Obtained from environmental sample
atgcaaacttcttatgcttttgtaaatcaacaacttgttccttttgatgccgccagcatcagcattgccgatctgggcctgctgaggggctatggggttttcgattttttcaggctggtagccggacagccattttattttgatgcacattgggcaagattgcagcattcggcttcccttttgcatttgccggtaccctttagccgcgctgaatgccttgatatggtggctgaattgtatcgcctgcattccctttctcatgccgggattcgcataaccattacgggaggcaacagccccgatggctatttaccggcgaagccaaacagcctggtcacctggcagccggtggccgatttgcctgatgtgctgccggcagaagggattgccttgtggccttacccataccaacgcccgctgcccggagtaaaatcgaccgattacctgatgggtatatggctacagcctatggctaaggaaaagggttgtcatgatgtgctttatcattgggaagaccgggtttcggaatgtccgcgcagtaatgtttttgccatcacccaaagtggcgaactcataacccccgatacaggaatgctggagggtattaccaggcaaagggtgatcaaactcgcacagggtttggtacccgtttcctgccgcacggtgcagctaacggagctctgccaggcatctgaagtttggattaccagcactaccaagggtatattgccggtaacccgcattggcgatcataccattggcgccggactcaccggtccggtggcccaaatgctctatcgaaaactgcgggaggaggaatag

SEQ ID NO: 160 - protein, 273 aa, Unknown
  Obtained from environmental sample
  DOMAIN (9)...(270): Aminotransferase class IV
MQTSYAFVNQQLVPFDAASISIADLGLLRGYGVFDFFRLVAGQPFYFDAHWARLQHSASLLHLPVPFSRAECLDMVAELYRLHSLSHAGIRITITGGNSPDGYLPAKPNSLVTWQPVADLPDVLPAEGIALWPYPYQRPLPGVKSTDYLMGIWLQPMAKEKGCHDVLYHWEDRVSECPRSNVFAITQSGELITPDTGMLEGITRQRVIKLAQGLVPVSCRTVQLTELCQASEVWITSTTKGILPVTRIGDHTIGAGLTGPVAQMLYRKLREEE

SEQ ID NO: 161 - DNA, 861 bp, Unknown
  Obtained from environmental sample
atgacgcgcaccgtatatgtgaatggccaatacctgcccgaagctgaggcaaccgtttcgatctttgatcgggggtttctgatggcggacgcagtttatgaagtgaccagcgtgctggatggcaagctgatcgattttgaaggccacgctgtgcgcctgaaccgctcgcttgaggcgctggaaatggcgtcgccttgctccaaagacgaattgctggggatccaccgcaggttggtggctgaaaacaacatcgtcgaaggtctggtgtatctgcaagtgtcgcgcggcagcgacggggatcgcgattttgtctacccctctgcggacaccaagccgactttggtgctgttcacgcagaacaaaccgggtttggcggacaaccctgcggccaagaaaggcgccaagatcatctcgatcgaggacattcgttggggccgtcgcgacatcaaaaccgtgcagctgctgtatccgtcgatgggcaaaatgatggccaagaaagccggctgtgatgatgcttggttgattgaggatggctatgtcaccgagggcacgtccaacaacgcctattttgtcaaaggcggcaagatcgtcacgcggcctttgagcactgatatcttgcatggcatcacccgcaaggctgtgctgcggattgcggctgaggcgcagatggaggtcgaagagcgactgttcaccatcgaggaggcccaagctgcggatgaggcgtttaccacctcggccagcgcgtttgtgatgccggttgtggaaattgacggtgtggcgcttggtgacggaacacccgggccaattgcgcgccggttgcgtgagatttatctggaagagagcctgaaagcggcgatctag

SEQ ID NO: 162 - protein, 286 aa, Unknown
  Obtained from environmental sample
  DOMAIN (8)...(278): Aminotransferase class IV
  SITE (54)...(57): N-glycosylation site. Prosite id = PS00001
MTRTVYVNGQYLPEAEATVSIFDRGFLMADAVYEVTSVLDGKLIDFEGHAVRLNRSLEALEMASPCSKDELLGIHRRLVAENNIVEGLVYLQVSRGSDGDRDFVYPSADTKPTLVLFTQNKPGLADNPAAKKGAKIISIEDIRWGRRDIKTVQLLYPSMGKMMAKKAGCDDAWLIEDGYVTEGTSNNAYFVKGGKIVTRPLSTDILHGITRKAVLRIAAEAQMEVEERLFTIEEAQAADEAFTTSASAFVMPVVEIDGVALGDGTPGPIARRLREIYLEESLKAAI

SEQ ID NO: 163 - DNA, 1377 bp, Unknown
  Obtained from environmental sample
atgagcgtgcactcggtcactgagctccatgcagcctatgccgcgaaatttccccgatcggcggcctcggcccgcgccgcgaacgaggccatcgccggtggcgtggcgcatgatgggcgtgctgcctcgccgttcccgctctttatcgacagcgcccagggcgcgcgcaagcgcagcgtcgatgggcacgacctgatcgatttctggatgggccatggcgcgttgatgctgggccaccgccatcccgcgatcgaggcggccgtggcccagcagcttgcccggggaacgcactttggcgccagccacgaggccgaggtgcagtgggcgcagaagatcatcgaactggtcccttcggccgagctggtgcgcttcgtggcgtcgggaacggaagcgacgcacatggcgctgcgcctggcgcgggcagccacgggccgctcacgcatctgtcgcttcgaggggcatttccacggctggcacgactgggtcgccctggggaaccgtgcgcccttcgaccaaccaagctccggggggattgctccggcggtgcgcgacgagatcacggttctgcccaacaacgatgccaacgcgttgcgcgcggcgctggcggctggtgatgtggccgccgtcatcctcgaacctgggggcggcacgcagggacgggttcctctctgttcggaatttctctgtgaagtacgagacctgacgtcgcggcaggggacggttctgatcttcgacgaggtggtgacggggtttcgcatcgcgccgggtggtgtgcaggagcggagtggcgtcgtgcctgacctgacgaccctggccaagatcgtggctggcgggctgccgggtggggccgtttgcggcaagcgggaggtgatggatgtcctctcctttgcgccgcctgctggcgtgacgcgcgtggcgcaccccggaacgttcaatgccaatccgctcagtgccgccgctggcatcgcgatgctggaggaggtcgccgatggtggcccgctggacgatgccgccgcgagtgcggccatcctgcggcgcggcatcaacgatctcctggccgcgcgcggcatcgctggctttgcctatggcgatcgttccatcgtgcacatcctgctcgggccggccggacggcgagcgcgggcggctgacggtaatcttgacaccatccccgccgccgagttgctggcggccgatccggtcgtggcgaaagccttgcgcaccgcctgcctctttcacgggctggatctgatggggccgacgatgatggtcgcgagcgtccacgatgccgccgcgatcgacgaggcgctgacgaggttcgagcgggtgttcgccacgctgatggcgcttgacgagtgccaaccgattttggaggcctga

SEQ ID NO: 164 - protein, 458 aa, Unknown
  Obtained from environmental sample
  DOMAIN (48)...(364): Aminotransferase class-III
MSVHSVTELHAAYAAKFPRSAASARAANEAIAGGVAHDGRAASPFPLFIDSAQGARKRSVDGHDLIDFWMGHGALMLGHRHPAIEAAVAQQLARGTHFGASHEAEVQWAQKIIELVPSAELVRFVASGTEATHMALRLARAATGRSRICRFEGHFHGWHDWVALGNRAPFDQPSSGGIAPAVRDEITVLPNNDANALRAALAAGDVAAVILEPGGGTQGRVPLCSEFLCEVRDLTSRQGTVLIFDEVVTGFRIAPGGVQERSGVVPDLTTLAKIVAGGLPGGAVCGKREVMDVLSFAPPAGVTRVAHPGTFNANPLSAAAGIAMLEEVADGGPLDDAAASAAILRRGINDLLAARGIAGFAYGDRSIVHILLGPAGRRARAADGNLDTIPAAELLAADPVVAKALRTACLFHGLDLMGPTMMVASVHDAAAIDEALTRFERVFATLMALDECQPILEA

SEQ ID NO: 165 - DNA, 1314 bp, Unknown
  Obtained from environmental sample
atggacacgtaccgggcgatgcaccccaagtccggcgcgctgtacgagcgcgcgcgcaacgtcatctccggtggcatcacccacgacggccgtcacctcaacccgtacccggtgtacatcgaccgcgcgctgggctcgcgcaagtgggacgtggatgggaacgagtacgtcgactactggatggggcacggcgcgctgatcctgggccactgccaccccgctgtcgtcgcggcgatccagaagcaggccggccgcggaacgcatctcggcgcctcgcacgagctcgaggtgcgctgggccgagctggtctcgaagctcatcccgtcggccgagatggtgcgcttcacgatgtcgggcaccgaggccacgcacctcgcgatgcgcatcgcccgtgcctacacgaatcgcccgaagatcctgaagttccaggggcacttccacggctggcacgacggcgtcgccctcgccgtcgatccgccctacgacgtgccgtggtccgccggcgtgccggcctccacgctcgaccagatcctgctgtgcccgcccaatgacatcaaggcggtggagacggtgctccagcgtggcgacgtcgccgcggtgatcctcgagcccgccggaggcggctccagcaccatccccaccatccccggctatctccaagagctgcggagcctcaccgagcgcctgggcgtggtgttgatcttcgacgaggtgatctcgggcttccgctattcgccgggcggcgcgcaggcgtacttcggcgtgacgccggacatgaccaccctcgccaagatcgttgcgggtggcctccccggcggcgcggtggtgggcaagaagccgctcatgggcatgatggcccgccgcggcgacccggtgtgggaccgcagccagcgcgtggcccagaatggcacgttcaactcgaacccgctctgcgcggccgccgccatcgccacgctggagctggtctccgacggcagcctccacgcgcgcgccaacaaggtgggcgacgagctccgcacctcgctctccgacgtgatgaagcgggtgggcgtgcccggcaccaccttcggcgacgtgtccatcttccacgtgtcgttcgagggcaagcccggtctcgcgggcttcgatcgcccgcgccgcggtgatctctatcagctcctgcgctgcgcgctcctgaaccacgggctcgactgctcgagctatcacgggtggatctccgccgtgcactcgaacgaggacatcgaccgcaccgtgcagggctacgaggccgccttcaaggacatggcggccgacggcgccttcaagggcatgtaa

SEQ ID NO: 166 - protein, 437 aa, Unknown
  Obtained from environmental sample
  DOMAIN (39)...(363): Aminotransferase class-III
  SITE (157)...(163): N-6 Adenine-specific DNA methylases signature. Prosite id = PS00092
  SITE (306)...(309): N-glycosylation site. Prosite id = PS00001
MDTYRAMHPKSGALYERARNVISGGITHDGRHLNPYPVYIDRALGSRKWDVDGNEYVDYWMGHGALILGHCHPAVVAAIQKQAGRGTHLGASHELEVRWAELVSKLIPSAEMVRFTMSGTEATHLAMRIARAYTNRPKILKFQGHFHGWHDGVALAVDPPYDVPWSAGVPASTLDQILLCPPNDIKAVETVLQRGDVAAVILEPAGGGSSTIPTIPGYLQELRSLTERLGVVLIFDEVISGFRYSPGGAQAYFGVTPDMTTLAKIVAGGLPGGAVVGKKPLMGMMARRGDPVWDRSQRVAQNGTFNSNPLCAAAAIATLELVSDGSLHARANKVGDELRTSLSDVMKRVGVPGTTFGDVSIFHVSFEGKPGLAGFDRPRRGDLYQLLRCALLNHGLDCSSYHGWISAVHSNEDIDRTVQGYEAAFKDMAADGAFKGM

SEQ ID NO: 167 - DNA, 861 bp, Unknown
  Obtained from environmental sample
atggacgcgctgggctattacaacgggaaatggggacctctggacgagatgaccgtgccgatgaacgacaggggttgttactttggggacggcgtgtacgacgctgcctgtgccgccaacggaacgatctttgccccggatgagcatattgatcggtttttcagcggcgcaaagcttctggaaataaaaatcagcttaacaaaagaggaattgaaaagaaccctcaatgaaatgctctgtaaagtagacaagggggagtaccttgtttattggcaggcgactcgcggaacaggccgtcgaagccatgcatttccggcgggcccctcaaatctctggattatgataaagccccaccccatcgacgatctatataaaaaaataaagctcattaccatggaagacacccgctttctccactgcaacatcaagacccttaaccttattcccaatgtcatcgcttcccagcgggcgctggaagcgggctgctacgaaacggtatttcaccggggcgaaacggtaaccgagtgcgcccacgacaatgtccacatcatcaaaagcggcaggtttatcacccatcctgcaaacaacctgatcctcaggggcatagcccgcagtcatttattgcaagcctgcgacaggctggacattccggttgaagaacgggaatttagcctgtcggagttgtttgacgcggacgaggtgcttgtgtccagttgcggcagtttcggtcttagcgccgatgcaattgacggaaaagacgtgggaggaaaagcgccggaactgcttaaaaaaattcaggacgaggtgctgagggaatttatcgcagcgacaggctacgcgcccgcctggagcagggtgtag

SEQ ID NO: 168 - protein, 286 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFAPDEHIDRFFSGAKLLEIKISLTKEELKRTLNEMLCKVDKGEYLVYWQATRGTGRRSHAFPAGPSNLWIMIKPHPIDDLYKKIKLITMEDTRFLHCNIKTLNLIPNVIASQRALEAGCYETVFHRGETVTECAHDNVHIIKSGRFITHPANNLILRGIARSHLLQACDRLDIPVEEREFSLSELFDADEVLVSSCGSFGLSADAIDGKDVGGKAPELLKKIQDEVLREFIAATGYAPAWSRV

SEQ ID NO: 169 - DNA, 882 bp, Rhodococcus erythropolis DSMZ 44522
atggctgaccatccgggcgtcgtcgtcaccctcgacgggcagctgcacgacccgcaggcgccgttgctgtacgccgacgacctcgcggcagtgcggggcgacggcatcttcgagaccctgctggtgcgtgacggcggaccgtgcctgctgggcgcgcacctggaccggctggcgcactccgcccgcctcgtcgacctgcccgagcccgacgccgggcagtggcgggcggcggtggccctcgcggtggagcactggctggccgggggatcggacgaaggcgtgctgcggctggtgtacagccggggacgcgaacacggttcggcgcccaccgcgtacgcggcggtcgggtcgctgccgtcacgggtcgcggccgtgcggcgcgacggggtggcggcgatgaccctgcaacgcagcctgcccgcggacggcatcgacgcgatgccgtggctgctggccggcgcgaagacgctgtcgtatgcggtgaacatggccgcgctgcggcatgcggaacggcacggcgccggcgacgtcatcttcgtcagtaccgacgggcacatcctggagggtcctcgatcgaccgtcgtcatcgcgaccacctcacctgacggcgcaacgtgcctgctgacgccgccgccgtggtatccgatcctgcgcggcaccacccagcaggcgctgttcgaggttgcccgcaacaagggctacgactgcgactaccaggccctgcggcccgccgacctggttgccgcgcaaggagtctggctggtctccagcatcacgctggccgcccgggtgcacactctcgacggtgcgccgttgcctgcggcaccgctggacggtgagatcgccgcgctgatcgacgcggccgtcctcagcgatcgctga

SEQ ID NO: 170 - protein, 293 aa, Rhodococcus erythropolis DSMZ 44522
  DOMAIN (12)...(290): Aminotransferase class IV
MADHPGVVVTLDGQLHDPQAPLLYADDLAAVRGDGIFETLLVRDGGPCLLGAHLDRLAHSARLVDLPEPDAGQWRAAVALAVEHWLAGGSDEGVLRLVYSRGREHGSAPTAYAAVGSLPSRVAAVRRDGVAAMTLQRSLPADGIDAMPWLLAGAKTLSYAVNMAALRHAERHGAGDVIFVSTDGHILEGPRSTVVIATTSPDGATCLLTPPPWYPILRGTTQQALFEVARNKGYDCDYQALRPADLVAAQGVWLVSSITLAARVHTLDGAPLPAAPLDGEIAALIDAAVLSDR

SEQ ID NO: 171 - DNA, 864 bp, Unknown
  Obtained from environmental sample
atggacgcgctgggttattacaacggaaaatgggggcctctggacgagatgaccgtaccgatgaacgacaggggctgttactttggggacggcgtgtacgacgctgcctgcgccgccaacggaacgatctttgccctggatgaacatattgaccggtttttcaacggcgcaaagctcctggaaataaaaatcggcttatcaaaagaggaactgaaaagaactcttaatgaaatgctctgtaaagtggacaagggggagtacatggtttattggcaggcgactcgcggaacaggccgtcgaagccatgtatttccggcaggcccctcaaatctctggattatgataaagccccatcccatcgacgatctttataaaaaaataaagctcattaccatggaagacacccgctttctccactgcaacatcaagacccttaaccttattcccaatgtcattgcctcccagcgggcgctggaagcgggctgctacgaaacggtatttcaccggggcgaaacagtaaccgagtgtgcccacgacaatgtccacatcatcaaaaacggcaggtttatcacccatccggtggacaacctaatcctccggggcatagcccgcagtcatttattacaagcctgcgacaggctgaacattccggttgacgaacgggaatttagcctgtcggagttgtttgacgcggacgaggtgcttgtgtccagttgcggatctttcggccttagcgccgatgcaattgacggaaaagacgtgggaggaaaagcgccggaactgcttaaaaaaattcaggacgaggtgcttagggaatttgtcgaagcgacaggctacacgcctgcgtggaacaagaaagtatag

SEQ ID NO: 172 - protein, 287 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFALDEHIDRFFNGAKLLEIKIGLSKEELKRTLNEMLCKVDKGEYMVYWQATRGTGRRSHVFPAGPSNLWIMIKPHPIDDLYKKIKLITMEDTRFLHCNIKTLNLIPNVIASQRALEAGCYETVFHRGETVTECAHDNVHIIKNGRFITHPVDNLILRGIARSHLLQACDRLNIPVDEREFSLSELFDADEVLVSSCGSFGLSADAIDGKDVGGKAPELLKKIQDEVLREFVEATGYTPAWNKKV

SEQ ID NO: 173 - DNA, 861 bp, Unknown
  Obtained from environmental sample
ttggacgcgctgggatactacaacggcaaatggggccccctggacgaaatcaccgtgccaatgaacgacagaggctgctacttcggagacggcgtgtacgatgccgcctgcgcggctaacggagtgacctttgccctggatgagcacattgatcgttttttcaacagcgcagagctcctggaaataaaaatcaatttaacaaaagaagaactgaaaaaaaccctcaatgaaatgtgctccaaagtggataagggagtgtacatggtttattggcaggtaactcgcggaacaggccggcgtaaccatgtttttccggaaggcccctcaaatctctggattatgataaagccttatcccttatgtgatctttataaaaaaataaagctcatcacaatggacgatacccgctttctccactgcaacattaagaccattaaccttattccaaatgtcattgcatcccagcgggcgctggaagcgggctgttacgaaacggtatttcaccggggcgaaacagtaaccgagtgcgcccacagcaatgtccacatcctcaaaaacggcaggtttatcacccatcaggcggacaatctgatcctcccgggcattgcccgcagccatatattgcaggcctgcggcaggctgaaaatcccggttgacgagcgggagtttaccctttcggaattgtttgacgcggacgaggcgattgtgtccagcagcggtgatttctgcgttagcgccgaaataatcgatggaaaaagcgtgggagggaaagcgccggaactgcttaaaaaaattcaggacgaagtgttgagggaatttaccgaagcaactggctatacgcctgagtggagtaaggtatag

SEQ ID NO: 174 - protein, 286 aa, Unknown
  Obtained from environmental sample
  DOMAIN (8)...(270): Aminotransferase class IV
MDALGYYNGKWGPLDEITVPMNDRGCYFGDGVYDAACAANGVTFALDEHIDRFFNSAELLEIKINLTKEELKKTLNEMCSKVDKGVYMVYWQVTRGTGRRNHVFPEGPSNLWIMIKPYPLCDLYKKIKLITMDDTRFLHCNIKTINLIPNVIASQRALEAGCYETVFHRGETVTECAHSNVHILKNGRFITHQADNLILPGIARSHILQACGRLKIPVDEREFTLSELFDADEAIVSSSGDFCVSAEIIDGKSVGGKAPELLKKIQDEVLREFTEATGYTPEWSKV

SEQ ID NO: 175 - DNA, 861 bp, Unknown
  Obtained from environmental sample
atggacgcgcttggctattacaacggaaaatgggggcctctggacgagatgaccgtgccgatgaacgacaggggatgctactttggagacggcgtttacgacgctacctgcgccgctaacggagtgatctttgccctggatgagcatattgaccggtttttcaacagcgcaaagcttctggaaatagaaatcagtttaacaaaaggggaactaaaaaaaacccttaatgaaatgcactccaaagtggataagggggagtacctggtttattggcagacgacccgcggaacaggccggcgaaaccatgtttttccggcaggcccctcaaatctctggattatgataaagccctatcccatcgacgatctttatcgaaaaataaagctcatcactatggaagatacccgctttttccactgcaacatcaagacacttaaccttattcccaatgtcattgcctcccagcgtgctctggaagtcggctgccacgaggcggtctttcaccgcggcgaaacagtaaccgagtgcgcccacagcaatgtccacatcatcaggaacggcaggtttatcacccaccaggcggacaacctgatcctccggggtatagcccgcagccatttattgcaagcatgcgtcaggctgaacattccggttgacgaacgggagtttaccctttcggaattgtttgacgcggacgaggtaattgtatccagcagcggcactttaggccttagcgccgatacaatcgatggaaaagccgtgggagggaaagcgccggagctgcttaaaaaaatccaggacgaagtgctgagggaatttaccgaagttacaggctataagcctgcgtggagcagggtatag

SEQ ID NO: 176 - protein, 286 aa, Unknown
  Obtained from environmental sample
  DOMAIN (8)...(270): Aminotransferase class IV
MDALGYYNGKWGPLDEMTVPMNDRGCYFGDGVYDATCAANGVIFALDEHIDRFFNSAKLLEIEISLTKGELKKTLNEMHSKVDKGEYLVYWQTTRGTGRRNHVFPAGPSNLWIMIKPYPIDDLYRKIKLITMEDTRFFHCNIKTLNLIPNVIASQRALEVGCHEAVFHRGETVTECAHSNVHIIRNGRFITHQADNLILRGIARSHLLQACVRLNIPVDEREFTLSELFDADEVIVSSSGTLGLSADTIDGKAVGGKAPELLKKIQDEVLREFTEVTGYKPAWSRV

SEQ ID NO: 177 - DNA, 1374 bp, Unknown
  Obtained from environmental sample
atgacgaccacgctgcggatcaccgaccagtacaccgccgaccacccgaaatcgcgggcgctgcatgagcgggcgcgcaccgtgatccccggcggcatcgcccatgatgtccgcaacatgcggccctttcccctgacgatggagcgcggcgagggcgcgtacaagtgggacgtggacggccatcagtacaccgattacgtggtcgggcacggctcgctgatcctggggcacagccacccgcaggtcgtggaggccgtgcgcacgcaaatgacgcagggcacccacctgggcgcgggcacgccgcacgagatcgcctgggccgaactcgtgcaacggctgatccccagcgccgacctgacgaagttcacctcgagtggcaccgaagcaacaatgatggcgatgcgcctcgcacgggcgtacacgggcaaagacaaaatcctcaagttcgccggccacttccacggctggcacgattacgccgtggcggggcagacgccgccgtgggacgtgcccgcctccgccggtgtgccgggggaaacgctctccacgatggtgatcgcccccgtgaacgacctcgacttcgtggatgcccgcctcgcgcaaggcgacatcgcaggcgtgattctggaggcgagcggcgcgtcgtgggcggcgatcccgcaccctcccggctacctccagcggctgcgtgagatcacggcccggcatggcgtcgtgatgattatggatgaagtgatcaccggctttcgctactcccccggtggcgtccaggccgtggagggcgtgacgcccgacctgaccacgctggcgaagattctcgcgggcggcctgcccggtggcgcggtggcgggcaaggcggagatcatgaacctgctcaccttccgcgacgacccgcagtggaaccgctatcacaaggtcgggcaccccggtacgtacaacgccaacccgctctccgccgtggcgggcgtgaccgcgctgacgatcctttccgaccccacacatcagcagtacgccgatgccctcgcggtgcggctgcgggcgggcttcaaccgcgtgctgctgcatgaagaagtccctggcttttgccacggcgaatcgagcatgtttcacctcgtgctcggcacgtcgtatcccggtggcacgccggacggcgatttgcagcgcccagagagcgtcgcgccggaaatcctcaagcgcggtatcgcgcccaagctcgacgcgcccctgtactgcggcatggttgccgaaggcgtagacctctttcatggcggtggcatgctttccaccgcgcacaccgaggcagatgtagaccgcaccatcgaagcattcgacaccgccgtgcgccgcatgacgaacgaaggagccttcgagtag

SEQ ID NO: 178 - protein, 457 aa, Unknown
  Obtained from environmental sample
  DOMAIN (46)...(364): Aminotransferase class-III
MTTTLRITDQYTADHPKSRALHERARTVIPGGIAHDVRNMRPFPLTMERGEGAYKWDVDGHQYTDYVVGHGSLILGHSHPQVVEAVRTQMTQGTHLGAGTPHEIAWAELVQRLIPSADLTKFTSSGTEATMMAMRLARAYTGKDKILKFAGHFHGWHDYAVAGQTPPWDVPASAGVPGETLSTMVIAPVNDLDFVDARLAQGDIAGVILEASGASWAAIPHPPGYLQRLREITARHGVVMIMDEVITGFRYSPGGVQAVEGVTPDLTTLAKILAGGLPGGAVAGKAEIMNLLTFRDDPQWNRYHKVGHPGTYNANPLSAVAGVTALTILSDPTHQQYADALAVRLRAGFNRVLLHEEVPGFCHGESSMFHLVLGTSYPGGTPDGDLQRPESVAPEILKRGIAPKLDAPLYCGMVAEGVDLFHGGGMLSTAHTEADVDRTIEAFDTAVRRMTNEGAFE

SEQ ID NO: 179 - DNA, 855 bp, Unknown
  Obtained from environmental sample
atgaacaaaattaatgcttttgtcaacggcgactacctgcctgctgaagaggcatgtcttaacattgaagacagagcttccctttttggcgacggctgctatgaattttttaaagtacaccgcggcaaggtttttgaaactgaggcacatttaaagaggctgcactacagcgccggggaacttgaaataagaattccttacagcgacaaagaaattactgaaatcttggataagctaattgagcttaattccattgaatacggcggaatttacctgcagctgacaaggggtgccgccccgcgcattcacaattatcccgacaggtgttcgccaaacttttttattgtggcccgggaaatgccgccgatggaaaagaagctcttggaagaaggcatcaaagctgtgctgctgcctgatgagcgctggaagcgctgtgatattaagtcgcttaacctgctggccaatattatggccaaggaaaaagcaaaaaagatgggtgctttggatgccattttgtacagtgaactgggtgtgaccgagtccaccagcagcagtgtgcttgctgtgttaaacggtgaattggtgaccacgccggagggtaactggattttgcctggtctcaccaaaagggtggccatgcggattgccaaagaaaacaatattaatgtacaggaaaggtttatgagcaccgatgagcttctggccgctgaggaaataatgctggccggaacaaggattgaccttttgcctgtgacagagcttgacggcaagcctgtgggaaccggtaaggtgggtcctgttaccaaaatactgctaagcggttttgcacgtgccctggatgagaatgtcaaatag

SEQ ID NO: 180 - protein, 284 aa, Unknown
  Obtained from environmental sample
  DOMAIN (9)...(276): Aminotransferase class IV
MNKINAFVNGDYLPAEEACLNIEDRASLFGDGCYEFFKVHRGKVFETEAHLKRLHYSAGELEIRIPYSDKEITEILDKLIELNSIEYGGIYLQLTRGAAPRIHNYPDRCSPNFFIVAREMPPMEKKLLEEGIKAVLLPDERWKRCDIKSLNLLANIMAKEKAKKMGALDAILYSELGVTESTSSSVLAVLNGELVTTPEGNWILPGLTKRVAMRIAKENNINVQERFMSTDELLAAEEIMLAGTRIDLLPVTELDGKPVGTGKVGPVTKILLSGFARALDENVK

SEQ ID NO: 181 - DNA, 876 bp, Unknown
  Obtained from environmental sample
atgacggagatggtatctgtaaatggccggatcacggatttgcatacggcacatataccgattttggatcgagggtttttgtacggggattccatatttgagagttttcgcagctatgacggaggttttttcgggttatcagagcatttggcccgttttcgccgctccgccgacatgctgcgcatgcccatgccgctggatgaggtagcgtggcgagagcagatggctgctaccatgcaggcagccggatcaggcgattatgtggttcgactgattcagacgcggggatcggctccttttcatcagggattgcgcaaggcagagcatcctttgtctattgtcatggtgcgtgagctgccaccacctgatccatccctggttcagcatggctgtcgtttgtatctttcaagcgtacgccgtaatgattcaagggcgctgaacccctcggcaaaaaccggcaattatctgaataatgtgctggccatgatggaagcagaagcccatggttgccatgaagccctgatgttgaatgcacagggcgaagtgaccgaaggtacccgatccaatctgtttatcgtgcgagaagggattctttgtactcctcctttatcagccgggattctggaaggcattacgcgcgagatggtcatgcgggtagcatgcgaggaaggtatttcatgtcaggaaacgccacttatgcccgatgatatgctgcaggctcaggaggtatttattaccagttcgatcagtgaagtgcttccggcggttatgctgaatgagtcggtgattggagagggctttccgggccctgtcacgaagcaactggcagaggcctatggccgctatcgtgacagaaacctggagcgtctgttctag

SEQ ID NO: 182 - protein, 291 aa, Unknown
  Obtained from environmental sample
  DOMAIN (8)...(280): Aminotransferase class IV
  SITE (143)...(146): N-glycosylation site. Prosite id = PS00001
MTEMVSVNGRITDLHTAHIPILDRGFLYGDSIFESFRSYDGGFFGLSEHLARFRRSADMLRMPMPLDEVAWREQMAATMQAAGSGDYVVRLIQTRGSAPFHQGLRKAEHPLSIVMVRELPPPDPSLVQHGCRLYLSSVRRNDSRALNPSAKTGNYLNNVLAMMEAEAHGCHEALMLNAQGEVTEGTRSNLFIVREGILCTPPLSAGILEGITREMVMRVACEEGISCQETPLMPDDMLQAQEVFITSSISEVLPAVMLNESVIGEGFPGPVTKQLAEAYGRYRDRNLERLF

SEQ ID NO: 183 - DNA, 825 bp, Unknown
  Obtained from environmental sample
atgatcacaacttatttcaacggacgttacattgacgccggtgaggctgtcatccctatcgaggagcgtggccacaattttggtgacgggatttacgatgtcatccgcgtgtacaacggggagccgtttttcctcgaggaacaccttgaccgcatttttatgagtgcccgagagattcgactcgatatcgggtacgaccgtgaaggcttcaaacagttgctccacgacgttgttgcgacaaacggcggcacaaacgtcgacatctatctacaggtgacacgtggcatcgctccacgggcgcatgcttttccgcaagcacccgcatcggtgagcatcattgtgcggcccagccccgcatacaccggtacatcagatgcgatgctgcacccggatgagcggtgggcgaactgctacatcaagtcgctcaacctcttgcccaacattctcgccttccagacagcgcaagataacggctgctgcgaggcaattctcgtcaaggacggacacatcacggaaggctcacgcacttcggtgatgatggtcaaacatggcgaggtgtgggcgccggtgttgacgaagcaaattctgtcgagcatcacccgcatggctgtcaagcaagccgccgcccgagccgggatcccctttatcgagaaggatttcacgcccgaggagttgatcgctgccgatgaagtgttcatcgccggaacgggcagcgaaatccatcccattcaccgcatcgacggcgctgacatcggtaacggcacaacaggttccatcaccactaccctaatcgacgagtttatgagactcacccgcggcgagtag

SEQ ID NO: 184 - protein, 274 aa, Unknown
  Obtained from environmental sample
  DOMAIN (7)...(268): Aminotransferase class IV
  SITE (256)...(259): N-glycosylation site. Prosite id = PS00001
MITTYFNGRYIDAGEAVIPIEERGHNFGDGIYDVIRVYNGEPFFLEEHLDRIFMSAREIRLDIGYDREGFKQLLHDVVATNGGTNVDIYLQVTRGIAPRAHAFPQAPASVSIIVRPSPAYTGTSDAMLHPDERWANCYIKSLNLLPNILAFQTAQDNGCCEAILVKDGHITEGSRTSVMMVKHGEVWAPVLTKQILSSITRMAVKQAAARAGIPFIEKDFTPEELIAADEVFIAGTGSEIHPIHRIDGADIGNGTTGSITTTLIDEFMRLTRGE

SEQ ID NO: 185 - DNA, 825 bp, Unknown; identical to SEQ ID NO: 183
  Obtained from environmental sample

SEQ ID NO: 186 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 187 - DNA, 861 bp, Unknown
  Obtained from environmental sample
atggacgcgctgggctattacaacggaaaatgggggcctctggacgagatgaccgtaccgatgaacgacaggggctgttactttggagacggcgtgtacgacgccgcatgcgccgccaacggaacgatctttgccccggatgagcatatcgaccggtttttcaacggcgcaaagctcctggaaataaaaatcagcttaacaaaagaggaactgaaaaaaacccttaatgaaatgctctgtaaagtggacaacggggagtgcctggtttattggcaggcgacccgcggaacgggccgtcgaagccatgtatttccggcaggcccctcaaatctctggattatgataaagcctcatcccatcgacgatctttataaaaaaataaagctcattaccatggaagacacccgctttctccactgcaacatcaagacccttaatcttattcccaatgtcatcgcctcccagcgggcgctggaagctggttgctacggaacggtatttcaccggggcgaaactgttaccgagtgcgcccacgacaatgtccacatcatcaaaaacggcaggtttatcacccatccggcggacaacctgatcctccggggcatagcccgcagtcatttattgcaagcctgcgacaggctggacattccggttgaagaacgggagtttactctttcggaactgtttgacgcggacgaggtacttgtatccagttgcggcactttcggtcttagcgccgatgcaattgacggaaaaggcgtggggggaaaagcgccggaactgcttaaaaaaattcaggacgaggtgctgagggaatttatcgaagcgacaggctacgcgcctacatggagcagggcatag

SEQ ID NO: 188 - protein, 286 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFAPDEHIDRFFNGAKLLEIKISLTKEELKKTLNEMLCKVDNGECLVYWQATRGTGRRSHVFPAGPSNLWIMIKPHPIDDLYKKIKLITMEDTRFLHCNIKTLNLIPNVIASQRALEAGCYGTVFHRGETVTECAHDNVHIIKNGRFITHPADNLILRGIARSHLLQACDRLDIPVEEREFTLSELFDADEVLVSSCGTFGLSADAIDGKGVGGKAPELLKKIQDEVLREFIEATGYAPTWSRA

SEQ ID NO: 189 - DNA, 864 bp, Unknown
  Obtained from environmental sample
atggacgcgctgggctattacaacggaaaatgggggcatctggacgagatgaccgtgccgatgaacgacaggggttgctactttggagacggtgtgtacgacgctgtctgcgccgccaacggaacgatctttgccctggatgagcatatcgatcggtttttcaacggcgcgaagctcctggaaataaaaattagcttaacaaaagaagaactgaaaaaaacccttaatgaaatgctctcaaaagtggacaagggagagtgcctggtttattggcaggcgactcgcgggacaagccgtcgaaaccatgcatttcctacaggcccctcaaatctctggattatgataaagccccatcccatcgatgatctttacaaaaaaataaagctcattaccatggaagacacccgcttcctccactgcaacatcaaaacccttaaccttattcccaatgtcatcgcctcccagcgggcgctggaagcgggctgctacgaaacggtatttcaccggggcgaaacagtaaccgagtgcgcccacgacaatgtccacatcatcaaaagcggcaggtttatcacccatccggcgaacaacctgatccttcggggcatagcccgcggtcatttactggaagcctgcctcaggctggacattccggtcgacgaaagggagtttaccctttcggaactttttgacgcggacgagatacttgtatccagttgcggcactttcggtcttagcgccgacgcaatagacggaaaagacgtgggggggaaagcgccggaactgcttaaaaaaattcaggacgaggtgctgagggaatttatcgaagcgacaggctacgcgcctgcctggagcaaaaaggtatag

SEQ ID NO: 190 - protein, 287 aa, Unknown
  Obtained from environmental sample
  DOMAIN (8)...(270): Aminotransferase class IV
  SITE (40)...(43): N-glycosylation site. Prosite id = PS00001
MDALGYYNGKWGHLDEMTVPMNDRGCYFGDGVYDAVCAANGTIFALDEHIDRFFNGAKLLEIKISLTKEELKKTLNEMLSKVDKGECLVYWQATRGTSRRNHAFPTGPSNLWIMIKPHPIDDLYKKIKLITMEDTRFLHCNIKTLNLIPNVIASQRALEAGCYETVFHRGETVTECAHDNVHIIKSGRFITHPANNLILRGIARGHLLEACLRLDIPVDEREFTLSELFDADEILVSSCGTFGLSADAIDGKDVGGKAPELLKKIQDEVLREFIEATGYAPAWSKKV

SEQ ID NO: 191 - DNA, 861 bp, Unknown; identical to SEQ ID NO: 187
  Obtained from environmental sample

SEQ ID NO: 192 - protein, 286 aa, Unknown; identical to SEQ ID NO: 188
  Obtained from environmental sample
  DOMAIN (8)...(270): Aminotransferase class IV
  SITE (40)...(43): N-glycosylation site. Prosite id = PS00001

SEQ ID NO: 193 - DNA, 861 bp, Unknown; identical to SEQ ID NO: 187
  Obtained from environmental sample

SEQ ID NO: 194 - protein, 286 aa, Unknown; identical to SEQ ID NO: 188
  Obtained from environmental sample
  DOMAIN (8)...(270): Aminotransferase class IV
  SITE (40)...(43): N-glycosylation site. Prosite id = PS00001

SEQ ID NO: 195 - DNA, 858 bp, Unknown
  Obtained from environmental sample
ttgaaaaatttggcctggttaaacggcagtatttgtgatatttctgaagcaaaggttccgcttgaagaccggggcttcttttttggcgacggggtatatgaggtaattaaaatatataatggtaagccattttatttggttccacatctaaaaaggcttcaaaacagcaccagtgctatcgagattgaacttccctctacgatcgaggaaattaaaacaagtattgctgatttaattaaaaagagcgaaatcctgaatgggtatctctacatgcagataacaaggggttgtgcagaaagagaccatttaccccctgtagatatcaagccttcgatgatcatgtatgtcagggagtttgatgcacctgcttcagtactggatcattttaaaccggccagttgtattactctgccggatgaaagatggcttcactgtaatattaaatcggttaatttgctgcccaatattctggccaggaaaaaagctgctaaagcaggtgctgtagaagcaatactataccgtccgggaggggtcgttacagaagggaccaggaccaatatatttgccgtgatcgatggcaaagtccgtacccatccggaatcaaatttaattttgtcgggtattaccaggagtatcgttattgacattatgagcaagcagcaggtcccctttcttgaagaagcaattaatgtagaggagctaaaacaggcatctgaagtgtggacgacctcttcgggaatagaaattcacccgatcagtattatagatgggcgaacggtgagtgaggatataccaggccctgtctgccggcatttgattgcagaatttcggaaaatcattgaagcagagtgttattaa

SEQ ID NO: 196 - protein, 285 aa, Unknown
  Obtained from environmental sample
  DOMAIN (8)...(277): Aminotransferase class IV
  SITE (8)...(11): N-glycosylation site. Prosite id = PS00001
  SITE (55)...(58): N-glycosylation site. Prosite id = PS00001
MKNLAWLNGSICDISEAKVPLEDRGFFFGDGVYEVIKIYNGKPFYLVPHLKRLQNSTSAIEIELPSTIEEIKTSIADLIKKSEILNGYLYMQITRGCAERDHLPPVDIKPSMIMYVREFDAPASVLDHFKPASCITLPDERWLHCNIKSVNLLPNILARKKAAKAGAVEAILYRPGGVVTEGTRTNIFAVIDGKVRTHPESNLILSGITRSIVIDIMSKQQVPFLEEAINVEELKQASEVWTTSSGIEIHPISIIDGRTVSEDIPGPVCRHLIAEFRKIIEAECY

SEQ ID NO: 197 - DNA, 858 bp, Unknown
  Obtained from environmental sample
gtgggaaatttggcctgggtaaatggtaaaatttctgaattagatgatgcaaaagttggagttcaggacaggggttttttatttggtgacggagtttatgatgttataaaaatatataacggtaatccattcaggctattatctcaccttgaaagactgcagcgaagctgtaatgctattagcatagaactgcctcattccataggagatgtagaggtagttgtagggaatttgattaaggagagcgcttgcaaggatggttttatttatatgcaggtgacaaggggttgtgcgccccgtgatcacttctttcctatcggggtggagcctacttttctgatctatatccttgatctcggtttcccctcaacaaaaagcagcctgaaagtaacagcatgcatcaccctcccggatgagcggtggatgaactgccatattaaatcgaccaacctgctccctaatgtactatccctgcaaaaagcaaaagaagcaggcgccggggaggcaatcttataccggccggatggcacggtaacagagggcacacggactaacatatttgccgtaattgacggcattgtccgcactcacccggaatccccgttaattttaccagggattacaaggaatattgccctggatatttttaaagaagctaatgtcgcggttttagaagaagctttctctactgatgatttaagcagggcttcagaagtatggacaacttccaccggtctagaaatatccccggttaataaaatcgatggccgcgtagttgacgcggccgctccaggttcggtttgcagcttactgctggatcatttttggcaaaaagtagaggaagaatgcggtgtttaa

SEQ ID NO: 198 - protein, 285 aa, Unknown
  Obtained from environmental sample
  DOMAIN (8)...(276): Aminotransferase class IV
MGNLAWVNGKISELDDAKVGVQDRGFLFGDGVYDVIKIYNGNPFRLLSHLERLQRSCNAISIELPHSIGDVEVVVGNLIKESACKDGFIYMQVTRGCAPRDHFFPIGVEPTFLIYILDLGFPSTKSSLKVTACITLPDERWMNCHIKSTNLLPNVLSLQKAKEAGAGEAILYRPDGTVTEGTRTNIFAVIDGIVRTHPESPLILPGITRNIALDIFKEANVAVLEEAFSTDDLSRASEVWTTSTGLEISPVNKIDGRVVDAAAPGSVCSLLLDHFWQKVEEECGV

SEQ ID NO: 199 - DNA, 858 bp, Unknown
  Obtained from environmental sample
ttgaaaaatttggcctggttaaacggcagtatttgtgatatttctgaagcaagggttccgcttgaagaccggggcttcttttttggcgacggggtatatgaggtaattaaaatatataatggtaagccattttatttggttccacatttaaaaaggcttcaaaacagcaccagtgctatcgagattgatcttccctctacgatcgaggaaattaaaataagtattgctgatttaattaaaaagagcgaaatcctgaatgggtatctctacatgcagataacaaggggttgtgcagaaagggaccatttgccccctgcagatatcaagccttcgatgatcatgtatgtcagggagtttgatgcacctgcttcagtactggatcattttaaaccggccagttgtattaccctgccggatgaaagatggcttcactgtaatattaaatcggttaatttgctgcccaatattctggccaggaaaaaagctgctaaagcaggtgctgtagaagcaatactataccgtccgggaggggtcgttacagaagggaccaggaccaatatatttgccgtgatcgatggcaaagtccgtacccatccggaatcaaatttaattttatcgggcattaccaggagtatcgttattgacattatgagcaagcagcaggtcccctttcttgaagaagcaattaatgtagaggaactaaaacaggcgtctgaagtgtggacaacctcttcgggaatagaaatccacccgatcagtattatagatgggcgaacggtgagtgaggatataccaggccctgtctgccggcatttgattgcagaatttcggaaaatcatagaagcagagtgttattaa

SEQ ID NO: 200 - protein, 285 aa, Unknown
  Obtained from environmental sample
  DOMAIN (8)...(277): Aminotransferase class IV
  SITE (8)...(11): N-glycosylation site. Prosite id = PS00001
  SITE (55)...(58): N-glycosylation site. Prosite id = PS00001
MKNLAWLNGSICDISEARVPLEDRGFFFGDGVYEVIKIYNGKPFYLVPHLKRLQNSTSAIEIDLPSTIEEIKISIADLIKKSEILNGYLYMQITRGCAERDHLPPADIKPSMIMYVREFDAPASVLDHFKPASCITLPDERWLHCNIKSVNLLPNILARKKAAKAGAVEAILYRPGGVVTEGTRTNIFAVIDGKVRTHPESNLILSGITRSIVIDIMSKQQVPFLEEAINVEELKQASEVWTTSSGIEIHPISIIDGRTVSEDIPGPVCRHLIAEFRKIIEAECY

SEQ ID NO: 201 - DNA, 855 bp, Unknown
  Obtained from environmental sample
atggaaatatgttatttaaatggtgactatattcccagggatgaggtaaggatcaatcctgacgatcgcggattcctctttgcagaaggcatctatgaagtggtaagatggtatgaagggtttttttacgatatggaaagccatctcggcaggatgaaaaggagtctcagtgaaataaagattcaatggcccggggaagattcctttcctgcaattgccatggaactgataaggttaaacaatcttgaaaatacacctgccctcatttacctgcaggttacaagaggttctgcgaaaagaacacattcattccccgatcctccggtaaaccctactgtttacgcatttgcaacaggttttgttccagaaaacagtgggaaggaatcaggtattggcattatgctgaaagaagatataaggtggagccgctgcgatattaaatcaatcgcccttcttccgaatacgctttgttttcaggaagctgtcgacaaaggttacttcgagtgtgcatttgtcagaaacggaatcatcaccgaatgtacccattcaaatatcttttttgtgatcaaaggtgttatttacacgcatcctgaatcggtttatgtcctgtcgggcattaccagaaaaaatataattcgtgttgccagaaaagcagaaattaccgttatagaagaggcagtatcagaaaagatgctcggcgatgttcaggaaatattcattacgaacacttccggcgaaataacccctgttataaatgtcggttcggtggttattggcaatggaattaccggacctgtcacaaggatcatcagggaacgattcaatgatgaaatatgctccatcaaacattcctga

SEQ ID NO: 202 - protein, 284 aa, Unknown
  Obtained from environmental sample
  DOMAIN (7)...(275): Aminotransferase class IV
  SITE (245)...(248): N-glycosylation site. Prosite id = PS00001
MEICYLNGDYIPRDEVRINPDDRGFLFAEGIYEVVRWYEGFFYDMESHLGRMKRSLSEIKIQWPGEDSFPAIAMELIRLNNLENTPALIYLQVTRGSAKRTHSFPDPPVNPTVYAFATGFVPENSGKESGIGIMLKEDIRWSRCDIKSIALLPNTLCFQEAVDKGYFECAFVRNGIITECTHSNIFFVIKGVIYTHPESVYVLSGITRKNIIRVARKAEITVIEEAVSEKMLGDVQEIFITNTSGEITPVINVGSVVIGNGITGPVTRIIRERFNDEICSIKHS

SEQ ID NO: 203 - DNA, 921 bp, Unknown
  Obtained from environmental sample
atgctggaagaacgccaggtatggatcaatgggcagttcgtgccgtgggcccacgccacggtgcacatgatgtgccacagctttgcgcggggctccacgatattcgaagtgatcagcttctatgccgcagcggccggcggtccggccgtcttccggctgcacgatcatgtggcccgcttcgaaaaatcagccgcctacctcgccatggagctgcccgtggggcacgacgctctttgtcgggcggtggccgagaccgtgcgccgcaaccggctggagcaggggacgctcaaggtcgtcggctattatccgcagtttgcgctcgacgtccagccgccgcagcagcggctgtcgatcgccgtattcgcgatggacccctcccgggacattccggaactcgggttttcgtttgagcagggcaccacggcgggcatcgcccgctggcgcaagctggacccccaaagcgttccgattgaggccaaggcggccgccaactatctcaacgggatggttgccaagctggaggtccagaagcgcggcttcgaggatgccatcctgctcgacacccagggcttcattgccgagggggcgaccgaatcgatctttttggtccagagcggccgcctgctgaccccatcgctcggcacggtgctggacagcatcacgcggcgcagcatattgcaggtggcggaccacctcgggatcgacgccttcgaaggccgcctgcggccggagctgctgttcgaggcggacgaggttttctttgccaacacccccttcaaggtgatccccgtacggcgcatcgaggagcgcgagatgccggctgtgccggggcctgttcaggcgaggctctatgggtttttggcccgggcggcgcgcggcgaagaagcggcgttcaaggagtggttgtacccggtagcgtaa

SEQ ID NO: 204 - protein, 306 aa, Unknown
  Obtained from environmental sample
  DOMAIN (10)...(288): Aminotransferase class IV
MLEERQVWINGQFVPWAHATVHMMCHSFARGSTIFEVISFYAAAAGGPAVFRLHDHVARFEKSAAYLAMELPVGHDALCRAVAETVRRNRLEQGTLKVVGYYPQFALDVQPPQQRLSIAVFAMDPSRDIPELGFSFEQGTTAGIARWRKLDPQSVPIEAKAAANYLNGMVAKLEVQKRGFEDAILLDTQGFIAEGATESIFLVQSGRLLTPSLGTVLDSITRRSILQVADHLGIDAFEGRLRPELLFEADEVFFANTPFKVIPVRRIEEREMPAVPGPVQARLYGFLARAARGEEAAFKEWLYPVA

SEQ ID NO: 205 - DNA, 825 bp, Unknown; identical to SEQ ID NO: 183
  Obtained from environmental sample

SEQ ID NO: 206 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 207 - DNA, 825 bp, Unknown
  Obtained from environmental sample
atgacgacgactgcttttttcaatggacgctacatcgacgtcgatgaggccgtcatccccatcgaggagcgcggccacaacttcggtgacggcatttacgacgtgatccgcgtgtacaacggcatcccgtttttcatggaggagcatctcgaccgcattttcatgagcgcccgcgagattcggctcgacattgggtatgaccgtgacgggttccgtcagctgttgcttgacgcggtcgccacacacggcggcacaaacgtcgacatctacctgcaggtgacgcgtggaatcgcgacgcgcgcgcacgcgttcccgcaggccaacgcatcggtgagcatcatcgtgcgtccctcccccgcgtacaccggcacgcatgacgcgatgctgcaccccgacgagcgatgggcaaactgctacatcaaatcactcaacctgctgccgaacatcctcgccttccagacagcgcaagaaaacggctgttgcgaggccatcctcgtcaaggacgggcacgtcacggagggttcgcgcacgtcggtgatgatggtcaaggacggcgaagtgtgggcgccggtgctgacacagcagatcctgtcgagcatcacccgcatagccgtgaaaaaggccgcagggctcgccgggattccgtttgtcgagaagaacttcacacccgacaccctgcttgatgccgacgaagtgttcatcgccggaacgggtagcgaaatccaccccatccaccggatcgacggtcagaggataggcaacggcgagaccggccctgtcgtgtcaaccctcaccgacggattcttccgcctgaccgccagttga

SEQ ID NO: 208 - protein, 274 aa, Unknown
  Obtained from environmental sample
  DOMAIN (8)...(269): Aminotransferase class IV
  SITE (109)...(112): N-glycosylation site. Prosite id = PS00001
MTTTAFFNGRYIDVDEAVIPIEERGHNFGDGIYDVIRVYNGIPFFMEEHLDRIFMSAREIRLDIGYDRDGFRQLLLDAVATHGGTNVDIYLQVTRGIATRAHAFPQANASVSIIVRPSPAYTGTHDAMLHPDERWANCYIKSLNLLPNILAFQTAQENGCCEAILVKDGHVTEGSRTSVMMVKDGEVWAPVLTQQILSSITRIAVKKAAGLAGIPFVEKNFTPDTLLDADEVFIAGTGSEIHPIHRIDGQRIGNGETGPVVSTLTDGFFRLTAS

SEQ ID NO: 209 - DNA, 1374 bp, Unknown
  Obtained from environmental sample
atggcccaggcacccgtttctaccgacattcgcgcggcattcgaggagcggttcgccggctcccgggccatgtacgagcgatcccgccaggtcatcccgagcggcatcacccacgacggccgctacctccgccccttcccgatctacgtccagcgcgccgccggcgcccacaagtggtccgtcgatggccatgaactgatcgactactccatgggccacggctccctcatcctcggccacaacgacccggacgtcatcgccgcggtccaagcggccctgccaagcggcacccacttcggcgccgggcacgaaggcgaagtcgcctgggccgagcagatcgtgaagatgctgcgaagcgccgagaaggtgaagttcaccctctccggcaccgaagccaccctcctcgcaattcgcgtcgcccgcgcctacaccggcaagaccgttattctcaagttcgaaggccatttccacggctggaacgactacctcctcaagggcgagcggccaccctttgaaggcgcgccgatgcccggcatcccgcgcgagactctggacacggtcgcggtcgtcccggccgatctcgcctatgtcgaagagcgcctcagtcagggcgacatcgccggcgtcatcatcgaaccgagcggcggctcctgggctaccgttcccctgccggacggcttcctcgcgggcctccgcgccctcacgaccaagtacaacgccccgctcatcttcgacgaggtcatcaccggattccgctgggcccccggcggcgcccaggagttctacggcatcactccagacctcaccaccctcgccaagatcgtggccggcggcatgcccggcggcgccgtcgccggttcggccgcgctgatgaagcacctcgagttctcggatgagcccggttggaacgccacccgcaaggtccgccaccagggaacctacaattccaatccggtcgccgccgccgccgccctcgcttgcctcacgaagtgcgaagaccccggcgtgcagcagacctgtaacgatctcgcccgccggctccgcatcggcatgaacggcattctggcggaacggggcgctcccggcatcgtctggggcgacagctccgtcttccacgtcgtcctcggcgaggccagcgaggacgtcaccaagggcgacgtccgctaccccacaggcaagtccgccgaagctctcaaatcctccggccagggcccgctaaccgccacgctgcaccaaggcatgctcctcgaaggcgtcgacttcttcgcctccggcggcatgctcagcgtcgcccacaccgacgccgacctcgatcacacccttgccgccttcgatcgcgtcgtgcgccgcatggccgaccagggccttttctaa

SEQ ID NO: 210 - protein, 457 aa, Unknown
  Obtained from environmental sample
  DOMAIN (49)...(377): Aminotransferase class-III
  SITE (307)...(310): N-glycosylation site. Prosite id = PS00001
MAQAPVSTDIRAAFEERFAGSRAMYERSRQVIPSGITHDGRYLRPFPIYVQRAAGAHKWSVDGHELIDYSMGHGSLILGHNDPDVIAAVQAALPSGTHFGAGHEGEVAWAEQIVKMLRSAEKVKFTLSGTEATLLAIRVARAYTGKTVILKFEGHFHGWNDYLLKGERPPFEGAPMPGIPRETLDTVAVVPADLAYVEERLSQGDIAGVIIEPSGGSWATVPLPDGFLAGLRALTTKYNAPLIFDEVITGFRWAPGGAQEFYGITPDLTTLAKIVAGGMPGGAVAGSAALMKHLEFSDEPGWNATRKVRHQGTYNSNPVAAAAALACLTKCEDPGVQQTCNDLARRLRIGMNGILAERGAPGIVWGDSSVFHVVLGEASEDVTKGDVRYPTGKSAEALKSSGQGPLTATLHQGMLLEGVDFFASGGMLSVAHTDADLDHTLAAFDRVVRRMADQGLF

SEQ ID NO: 211 - DNA, 1137 bp, Unknown
  Obtained from environmental sample
ttgaaaaatccagaggtgtatgccattagctggaaaggttttcttccaaggcatctattccaaattggtttaaccagttatgtccttatgggccatggtgaagttcatgctggtcctgaagggatggagatcatagactgtggattggggacaaatcctcttggaatgccgccttcaatgtgggatgctttaaaggtattgcctgaggttgatctctcttgttacccatctccagagccggagaggttgaaaaaatccatcgttgaagcctatccttgttggcatttggatgcaaatcaaatcctcaccggtagaggatccatggccgttctgaccgctcttttacggctactccttccgcctggttcggtgctttccggtccttctccccagttcacggatgttgtgcttcaggcgctgttccatggggcaatctatgaccccgttgttctaaaaaaacctgcttttaccttgaatgtggaagatttaatgtccatattggggaaaaagccttctgttttgtacctagaccgaccccataatccgacaggacaagtactgcctttagatgaattggagacggtgactaaagaggccttggaaaaaggggtctgggttctcgtggacgaagcttatggcgactatctcctccctgatgaatctgcctgttctttgaactacccaaatctcatcaccagccgttctttttccaagggcttgggggctgcgggcttaagggtgggctatgcggtttgccgtgatgaggagttgacggccctttttcggaaagtcacccctcctttttctgtgagccgccttgatgaggagctagccgtagcggttctcaaggacacacattttttgagtgagacgcgaagctatgtgatggaagcaaagagaaggattatcaatgtgatcaaaggaaagcttgattggattgtagccgacacggacatgcgcacacccattttctttctttcccaacgttccggggatctggtggcgcggctctatgccgcaggcatcatctgcgagcctggaagcggatttatgggactcgacaaccgatttgccagacttcgcgtccctgctccagattctttggatctctttctggaacgtctcgcgcacgcctaa

SEQ ID NO: 212 - protein, 378 aa, Unknown
  Obtained from environmental sample
  DOMAIN (42)...(375): Aminotransferase class I and II
  SITE (238)...(251): Aminotransferases class-I pyridoxal-phosphate attachment site. Prosite id = PS00105
MKNPEVYAISWKGFLPRHLFQIGLTSYVLMGHGEVHAGPEGMEIIDCGLGTNPLGMPPSMWDALKVLPEVDLSCYPSPEPERLKKSIVEAYPCWHLDANQILTGRGSMAVLTALLRLLLPPGSVLSGPSPQFTDVVLQALFHGAIYDPVVLKKPAFTLNVEDLMSILGKKPSVLYLDRPHNPTGQVLPLDELETVTKEALEKGVWVLVDEAYGDYLLPDESACSLNYPNLITSRSFSKGLGAAGLRVGYAVCRDEELTALFRKVTPPFSVSRLDEELAVAVLKDTHFLSETRSYVMEAKRRIINVIKGKLDWIVADTDMRTPIFFLSQRSGDLVARLYAAGIICEPGSGFMGLDNRFARLRVPAPDSLDLFLERLAHA

SEQ ID NO: 213 - DNA, 849 bp, Unknown
  Obtained from environmental sample
atggatgcgcttggttattataacggaaaatggggccctcttgatgaaatgaccgtgccgatgaatgaccgcggctgttattttggagatggggtgtacgatgccgcgttggcctataacggggtgatttttacgctggacgaacatattgacaggttttttaacagcgccaaactgcttcaaatagaactctcttatacaaaagatgagctaaaaaagatcctggacgaaatggtaagcaagcttgatgaaaaatgcctctttgtctattggcaggcaacccgtgggacggaaaggcggaatcatgtttattccgggggtacatccaatctttggatcatgataaaaccagctccaatagttgaccttaccgtaaagcttaagcttattaccgtagaagatacacgttatctccattgtaatataaaaaccattaaccttattcccaacatcattgccgcccaaaaagcggcggaagcaggatgctatgaagctgtttttcaccggggcgaaatcgtaaccgaatgtacccgcagcaatgttcatatcataaagaacgggatttttattacccatcccgcagacaacctgatactgcggggaattgcgcgcagtcatcttatcaaagcctgtaacgttctggggattcctgtgcaggaacggaaatatactcttgcggagctttttgatgcggacgaggttcttgtttccagtacaggcagcatgtgcctttccgcggaaacggcagacggaaaaaatgttggcgggaaagcgcccgaattggttaaaaagctgcaggataaagtgtttggtgaattctgcgaagttacgggatacaaaaaactttaa

SEQ ID NO: 214 - protein, 282 aa, Unknown
  Obtained from environmental sample
  DOMAIN (8)...(270): Aminotransferase class IV
MDALGYYNGKWGPLDEMTVPMNDRGCYFGDGVYDAALAYNGVIFTLDEHIDRFFNSAKLLQIELSYTKDELKKILDEMVSKLDEKCLFVYWQATRGTERRNHVYSGGTSNLWIMIKPAPIVDLTVKLKLITVEDTRYLHCNIKTINLIPNIIAAQKAAEAGCYEAVFHRGEIVTECTRSNVHIIKNGIFITHPADNLILRGIARSHLIKACNVLGIPVQERKYTLAELFDADEVLVSSTGSMCLSAETADGKNVGGKAPELVKKLQDKVFGEFCEVTGYKKL

SEQ ID NO: 215 - DNA, 1386 bp, Unknown
  Obtained from environmental sample
atggtccaggaacagaccctcacgattgaggagcaattcatcgccgagcacccacgctcatatgagctctaccagcgcagccgcgcggcggtgcccggcggcatcacccacgacgttcgatatgccaagcctttcccgatttatgtcgaccaagccctcggctcgaagaagtgggatgtcgacggtcacgaactgatcgactacacgatgggccacggttccctcatcctcggccacagccatcccgagatcgtcgatgcagtcgtcgcgcagatgcgcaaggggacccactacggcgcgggccaccgcctggaagtcgagtgggccgaatgggtccatcgcctcatcccctcggccgagcgggtcaagttcacctcctccggaaccgaggcgacgatgctggccctgcgcctcgcgcgcgcctacaccggtcgcgaccggatcatgaagttcgccgggcacttccacggctggcacgactacgccatccccggcaatcagccgccattcgaccagccgccgccgggcgtcccggccgccgtgctcggcacgatcgcgctcgccccgaataatgacctcgggtttgtcgagcgcacactggccgatcccgatcacgacatcgccgccgtcatcctggagccgagcggcgcgtcctacgccacggtgccgctgccggatggtttcttgcagaagctgcgcgagatcaccgcgcgccacaatgtgctgctgatcttcgacgaggtcgtgaccggtttccgctggtcgcccggcggtgtgcaggggctgaccgggatcacgcccgatctgacgacgatggcgaagatcctggccggtggcctgccgggcggcgcagtcgccgggcgagcaccgatcctcgaactgctggagttcaaggacgaccccacctggaatcgcacccgcaaggtcgcgcaccccggcacctacaacgccaaccccctctcggcggcggccggcgtgacggcgctgcgcctcgtttccgacccggccgtgcagcgcggggccgagcgcctggcaagtagcctgaagcgcggattcaacgaggcgctgctgcgtcacgaggtccccggcttcgcctacggcgagagttcgatcgtcaacaccgtgatcggcacgcgctatcccggcagcctgccgctcgacctgaagcacccggtcggcgtggatccaatcgttctgaagcggggcggctcgcaagagttaacgcagtcgctgcacgccgcgatgatgatcgaggggatggacctctggcacggtgcgggcgcgatcctcagcatcacccacaccgatgaggatgtcgcgcgcaccgtcgaggcgttcgaccgcactctgggccgaatgcgcgccgaaggccattttccggattga

SEQ ID NO: 216 - protein, 461 aa, Unknown
  Obtained from environmental sample
  DOMAIN (48)...(376): Aminotransferase class-III
  SITE (308)...(311): N-glycosylation site. Prosite id = PS00001
MVQEQTLTIEEQFIAEHPRSYELYQRSRAAVPGGITHDVRYAKPFPIYVDQALGSKKWDVDGHELIDYTMGHGSLILGHSHPEIVDAVVAQMRKGTHYGAGHRLEVEWAEWVHRLIPSAERVKFTSSGTEATMLALRLARAYTGRDRIMKFAGHFHGWHDYAIPGNQPPFDQPPPGVPAAVLGTIALAPNNDLGFVERTLADPDHDIAAVILEPSGASYATVPLPDGFLQKLREITARHNVLLIFDEVVTGFRWSPGGVQGLTGITPDLTTMAKILAGGLPGGAVAGRAPILELLEFKDDPTWNRTRKVAHPGTYNANPLSAAAGVTALRLVSDPAVQRGAERLASSLKRGFNEALLRHEVPGFAYGESSIVNTVIGTRYPGSLPLDLKHPVGVDPIVLKRGGSQELTQSLHAAMMIEGMDLWHGAGAILSITHTDEDVARTVEAFDRTLGRMRAEGHFPD

SEQ ID NO: 217 - DNA, 825 bp, Unknown; identical to SEQ ID NO: 183
  Obtained from environmental sample

SEQ ID NO: 218 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 219 - DNA, 861 bp, Unknown
  Obtained from environmental sample
atggacgcactgggatattacaacggaaattgggggcctctggacgagatgactgtgccgatgaacgacaggggctgctactttggagacggcgtatacgacgctacctgcgccgttaacggagttatttttgccctggatgagcacattgacaggtttttcaacagcgcaaagctcctggaaataaatattagcttaacaaaagaggaattgaaaaaaactttaaatgaaatgtactccaaagtggataaaggagagtacctggtttattggcaggtgactcgcggaacaggccggcgaagccatgtatttccggcaggcccttcaaatctctggattataattaagcccaatcacatcgacaatctttatagaaaaatcaagctcattaccatggatgatacccgcttcctacactgcaacatcaagacccttaaccttatacccaatgtcattgcttcccagcgggcgctggaagcgggttgccacgaggcggtatttcaccggggcgaaacggtaaccgagtgcgctcacagcaatgtccatatcattaaaaacggcaggtttattacccatccggcggacaacctgatcctccggggtacagcccgcagtcatttattgcaggcctgtgtcaggcttaacattccggtagacgaacgggaattttccctttcggaattattcgacgcggacgaggtgcttgtgtccagcagcggcacactcggccttagcgccgaagaaatcgacggaaaaaaagcgggagggaaagcgcctgaactgctaaaaaaaatccaggatgaagtgctgagggaatttatcgaagcgacaggctacacgcctgagtggagcagggtatag

SEQ ID NO: 220 - protein, 286 aa, Unknown
  Obtained from environmental sample
  DOMAIN (8)...(270): Aminotransferase class IV
  SITE (63)...(66): N-glycosylation site. Prosite id = PS00001
MDALGYYNGNWGPLDEMTVPMNDRGCYFGDGVYDATCAVNGVIFALDEHIDRFFNSAKLLEINISLTKEELKKTLNEMYSKVDKGEYLVYWQVTRGTGRRSHVFPAGPSNLWIIIKPNHIDNLYRKIKLITMDDTRFLHCNIKTLNLIPNVIASQRALEAGCHEAVFHRGETVTECAHSNVHIIKNGRFITHPADNLILRGTARSHLLQACVRLNIPVDEREFSLSELFDADEVLVSSSGTLGLSAEEIDGKKAGGKAPELLKKIQDEVLREFIEATGYTPEWSRV

SEQ ID NO: 221 - DNA, 837 bp, Unknown
  Obtained from environmental sample
atggatatagcatatttcaatggcactttcattcccagggatgagatcaggataagtcctgatgaccgcggatttctgtttgcggaaggtatttatgaagtagtaaggtggtaccagggattcttttttgatatggatggtcatgtggcaaggatgaaaaggagtcttagggaaactctgatttcgtggccggaggaagaaaaattcccggtaattgccagggaactggttaagctgaatcatcttgagaattcacaggctcttgtttatcttcaggtaacaagaggagccgcaagccgtacccatgcatacccttcgccccccgtaagtccgacagcctatgcgtttgcaagggaattcacacccgagaatgccggcagggagtcgggagttgccataactgttaaggaagacatcagatgggcacgctgcgacatcaaatccattgcccttttacccaacaccctgggttttcaggatgccgtcagcaatggtttctttgaatgtgccttcgtcaggaacggattaatcactgaatgctcacattccaatatcttctttgttcagaaagggattgtctatacccatcctgaatcggaaagcatattatccggcatcaccaggaaaaacttaatcaaactggcccgcagggagggcatccccgtaaaggaggaagctatagctctcgcaaaactatcgaaggttcaggagatatttattaccaacacatcaggtgaaatcacccctgtggtcagggtggataattttgagatcggaggcggagttccgggacctgtaaccagaatactcagggaacggttcaacgatcagatccaa

SEQ ID NO: 222 - protein, 279 aa, Unknown
  Obtained from environmental sample
  DOMAIN (7)...(275): Aminotransferase class IV
  SITE (7)...(10): N-glycosylation site. Prosite id = PS00001
  SITE (245)...(248): N-glycosylation site. Prosite id = PS00001
MDIAYFNGTFIPRDEIRISPDDRGFLFAEGIYEVVRWYQGFFFDMDGHVARMKRSLRETLISWPEEEKFPVIARELVKLNHLENSQALVYLQVTRGAASRTHAYPSPPVSPTAYAFAREFTPENAGRESGVAITVKEDIRWARCDIKSIALLPNTLGFQDAVSNGFFECAFVRNGLITECSHSNIFFVQKGIVYTHPESESILSGITRKNLIKLARREGIPVKEEAIALAKLSKVQEIFITNTSGEITPVVRVDNFEIGGGVPGPVTRILRERFNDQIQ

SEQ ID NO: 223 - DNA, 867 bp, Unknown
  Obtained from environmental sample
atgtatccaattattttaacgcaaggtaaattccttcataaagatagcctaacatttccgatggaagaacgaggtttacaatttggcgacggtgtttacgaagtcattcgcctttataagggaaagccatatttattagatgaacatatcgagcgactttatcgttctttgcaggcaatacggattcaaatacattatacgcatgacgaaatggtagcaatgttacgcgatttgattcaacgcaatgaaattgataaggacggcattatttatttacaaatcacgcgtggctcggcgccccgtttgcacgtttttccggaaaatacgactcccaacttgtacgcatatgcaaaaaaacaaccacgttatacccattttttggaaaatggagttaaggctattacattagcagatgaacgttgggataattgctatattaagagtttgaatttgcttccaaacgtgcttgccaaacaaacggctgctgaactggaagcgtatgaagcgattttacaccgagatggtattgtgacagaatgtagttcctcgaatttgtttctagtgaaaaatggaactatttatacgcatccagcggaaaaacggatcctaaacggttgtgtccgcatggcagttaaacgtctcgctgaaaagttaagcctcccgtttatagaagaggccttcactttggacgatattgtttctgccgatgaactatttttaacgagtagtatttcagaggtgatgccgattgtgcaagtaaatgacaaacaggttgcaagtgggatgccaggaaagataacgcgccaacttcaacaagcttatgaagaagatgcaaagctaactttacaaaaagtatcttcgccctga

SEQ ID NO: 224 - protein, 288 aa, Unknown
  Obtained from environmental sample
  DOMAIN (8)...(275): Aminotransferase class IV
  SITE (192)...(195): N-glycosylation site. Prosite id = PS00001
MYPIILTQGKFLHKDSLTFPMEERGLQFGDGVYEVIRLYKGKPYLLDEHIERLYRSLQAIRIQIHYTHDEMVAMLRDLIQRNEIDKDGIIYLQITRGSAPRLHVFPENTTPNLYAYAKKQPRYTHFLENGVKAITLADERWDNCYIKSLNLLPNVLAKQTAAELEAYEAILHRDGIVTECSSSNLFLVKNGTIYTHPAEKRILNGCVRMAVKRLAEKLSLPFIEEAFTLDDIVSADELFLTSSISEVMPIVQVNDKQVASGMPGKITRQLQQAYEEDAKLTLQKVSSP

SEQ ID NO: 225 - DNA, 861 bp, Unknown
  Obtained from environmental sample
ttggacgcgctgggatattacaacggaaaatggggccccctggacgaaatcaccgtgccgatgaacgacagaggctgctacttcggagacggcgtgtacgatgccgcctgcgcggctaacggagtgacatttgcactggatgagcacattgaccgttttttcaacagcgcagaactcctggaaataaaaatcaatttaacaaaagaagaactgaaaaaaaccctcaatgaaatgtgctccaaagtggataagggagtgtacctggtttattggcaggtaacccgcggaacaggccggcgaaaccatgtatttcctgaaggcccctcaaatctctggattatgataaagccctatcccttatacgatctttataaaaaaataaagctcatcacaatggaagatacccgttttctccactgtaacattaagaccattaaccttattcccaatgtcattgcctcccagcgggcgctggaagcggactgctttgaaacggtatttcaccggggcgaaacagtaaccgagtgcgcccacagcaatgtccacatcctcaaaaacggcaggtttatcacccatcaggcggacaatctgatcctccggggcattgcccgtagccatatattgcaagcctgcgacaggctgaaaatcccggttgacgaacgggagtttaccctttcggaattgtttgacgcggacgaggcgattgtgtccagcagcggtgatttctgcgtcagcgccgaaataatcgacggaaaaagcgtgggagggaaagcgcctgaactgcttagaaaaattcaggacgaagtgctgagggaatttaccgaagcaactggctataagcctgaggggagtaaggtataa

SEQ ID NO: 226 - protein, 286 aa, Unknown
  Obtained from environmental sample
  DOMAIN (8)...(270): Aminotransferase class IV
MDALGYYNGKWGPLDEITVPMNDRGCYFGDGVYDAACAANGVTFALDEHIDRFFNSAELLEIKINLTKEELKKTLNEMCSKVDKGVYLVYWQVTRGTGRRNHVFPEGPSNLWIMIKPYPLYDLYKKIKLITMEDTRFLHCNIKTINLIPNVIASQRALEADCFETVFHRGETVTECAHSNVHILKNGRFITHQADNLILRGIARSHILQACDRLKIPVDEREFTLSELFDADEAIVSSSGDFCVSAEIIDGKSVGGKAPELLRKIQDEVLREFTEATGYKPEGSKV

SEQ ID NO: 227 - DNA, 861 bp, Unknown
  Obtained from environmental sample
atggaagcgctgggatactacaacggaaaatggggccccctggacgagatgaccgtgccgatgaatgacagaggctgctactttggagacggcgtgtacgacgccgcctgcgccgctaacggagtgatctttgtcctggatgaacacattgaccgctttttcgacagcgcaaagctcctggaaataaaaatcaatttaacaaaagaggaactaaagaagacccttaatgaaatgtgctccaaagtgaataagggagtgtacctggtttattggcaggcgacccgcggaacaggccggcgggatcatgtatttccggcaggcccctcaaatctctggattatgataaagccttatcccttatatgatctttataaaaagataaagctcatcactatggaggatacccgctttctccactgcaacatcaagacccttaaccttattcccaatgtcattgcctcccaacgggcgctggaagcgggctgcgatgaaactgtatttcaccggggcgaaacggtaaccgaatgcgcccacagcaatgtccacatccttaaaaacggcaggtttatcacccatcaagcggacaatctgatccttcggggcatagcccgcggccatatattgcaagcctgcgacaggctgaatattccggttgatgaacgggagtttaccctttcggaattgtttgacgcggatgaggtgattgtgtccagcagcggtgatttctgctccagcgccgaaataatcgacggaaaaagcgtgggggggaaagcgccggaactggtaaaaaaaattcaggacgaagtgctgagggaatttaccgaggcgacaggctatacgcctgagtggagtaaggtataa

SEQ ID NO: 228 - protein, 286 aa, Unknown
  Obtained from environmental sample
  DOMAIN (8)...(270): Aminotransferase class IV
MEALGYYNGKWGPLDEMTVPMNDRGCYFGDGVYDAACAANGVIFVLDEHIDRFFDSAKLLEIKINLTKEELKKTLNEMCSKVNKGVYLVYWQATRGTGRRDHVFPAGPSNLWIMIKPYPLYDLYKKIKLITMEDTRFLHCNIKTLNLIPNVIASQRALEAGCDETVFHRGETVTECAHSNVHILKNGRFITHQADNLILRGIARGHILQACDRLNIPVDEREFTLSELFDADEVIVSSSGDFCSSAEIIDGKSVGGKAPELVKKIQDEVLREFTEATGYTPEWSKV

SEQ ID NO: 229 - DNA, 873 bp, Unknown
  Obtained from environmental sample
atggatgcgctgggatattacaacggaaaatggggccccctggacgagatgaccgttccgatgaacgacagaggctgctatttcggagacggcgtgtacgacgcagcctgcgcggctaacggagttatctttgtcctggatgagcacattgaccgctttttcgacagcgcaaagctcctggaaataaaaatcaatttaacaaaagaggaactaaagaaaaccctcgataaaatgttctctgaaatgtgctccaaagtgaataagggagtgtacctggtttattggcaggcgacccgcggaacaggccggcgggatcatgtatttccggcaggcccctcaaatctctggattatgataaagccttatcccttatacgatctttataaaaaaataaagctcatcactatggaagatacccgctttctacactgcaacatcaagacccttaaccttattcccaatgtcatagcctcccagcgggcgctggaagcgggctgcgacgaaacggtattttaccggggcgaaacggtaaccgaatgcgctcacagcaatgtccacatcctcaaaaacggcaggtttatcacccatcaggccgataatctgatccttcggggcatagcccgcagccatatattgcaagcctgcggcaggctgaatattccggttgaggaacgtgatttcaccctttcggagttgtttgacgcggacgaggtgattgtgtccagcagcggtgatttctgcaccggcgccgaaataatcgacggaaaaagcgtgggggggaaagcgccggaactgctaaaaaaaattcaggacgaagtgttgagggaatttaccgaggcgacaggctatacgcctgagtggagtaaggtataa

SEQ ID NO: 230 - protein, 290 aa, Unknown
  Obtained from environmental sample
  DOMAIN (8)...(274): Aminotransferase class IV
MDALGYYNGKWGPLDEMTVPMNDRGCYFGDGVYDAACAANGVIFVLDEHIDRFFDSAKLLEIKINLTKEELKKTLDKMFSEMCSKVNKGVYLVYWQATRGTGRRDHVFPAGPSNLWIMIKPYPLYDLYKKIKLITMEDTRFLHCNIKTLNLIPNVIASQRALEAGCDETVFYRGETVTECAHSNVHILKNGRFITHQADNLILRGIARSHILQACGRLNIPVEERDFTLSELFDADEVIVSSSGDFCTGAEIIDGKSVGGKAPELLKKIQDEVLREFTEATGYTPEWSKV

SEQ ID NO: 231 - DNA, 864 bp, Unknown
  Obtained from environmental sample
atggacgcactgggctattacaacggaaaatgggggcctctggacgagatgaccgtgccgatgaacgacaggggctgttactttggagacggcgtttacgacgctgcctgtgccgctaacggaacgatctttgccccggatgagcatatcgaccggtttttcaacggcgcaaagctcctggaaataaaaatcaatttaacaaaagaggaactgaaaaaaacccttaacgaaatgctctctaaagtggacaagggggagtacctggtttattggcaggtgacccgtggaacgggccgtcgaagccatgtatttccggcaggcccctcaaatctctggattatgataaagccccaccccatcgacgatctttataaaaaaataaagctcattaccatggaggacacccgctttctccactgcaacatcaagaccctcaaccttcttcccaatgtcatcgcctcccagcgggcgctggaagcggactgctacgaaacggtatttcaccggggcgaaacagtaaccgagtgcgcccacgacaatgtccacatcgtcaaaagcggcaggttcatcacccatccggcggataacctgatcctccgtggtatagcccgcagtcatttactgcaagcctgcgacaggctgaacattccggttgaagaacgggaatttaccatttcggaactgtttgacgcggacgaggttcttgtgtccagttgcggctctttcggtcttagcgccgatgcaattgacggaaaaggcgtgggaggaaaagcccctgaactgcttaaaaaaattcaggacgaggtgctgagggaatttatcgaagcgacaggccacgcgcctgcctggagcaagaaggtataa

SEQ ID NO: 232 - protein, 287 aa, Unknown
  Obtained from environmental sample
  DOMAIN (8)...(270): Aminotransferase class IV
  SITE (40)...(43): N-glycosylation site. Prosite id = PS00001
MDALGYYNGKWGPLDEMTVPMNDRGCYFGDGVYDAACAANGTIFAPDEHIDRFFNGAKLLEIKINLTKEELKKTLNEMLSKVDKGEYLVYWQVTRGTGRRSHVFPAGPSNLWIMIKPHPIDDLYKKIKLITMEDTRFLHCNIKTLNLLPNVIASQRALEADCYETVFHRGETVTECAHDNVHIVKSGRFITHPADNLILRGIARSHLLQACDRLNIPVEEREFTISELFDADEVLVSSCGSFGLSADAIDGKGVGGKAPELLKKIQDEVLREFIEATGHAPAWSKKV

SEQ ID NO: 233 - DNA, 822 bp, Unknown
  Obtained from environmental sample
atggacagatacatccagatcaacgatcagctcatttccgccgcacaggccacgctgggggtgaccgacctgtccattcatcgcggttacggcatttttgattttttcaaaaccatcggtaaccgccccatctttcttgaagaccacctcgaccgcttttttgtttccgcacacgaaatgctgctcgatgtgccctatacgagggaagagctgcgcctgatgatcgcccggctgacggagaagaataacctgcccgactccggcatcaagatcatccttaccggcggctatgctgacgatggttataccattagcgggccgcccaacctcatcatgcagcaaacgccgctcgttatcaaagatttttctgacgatggtatgcgcctcatcaccttccatcaccagcggcaggtgcccctggccaaaagcatcgactatgtgcaggccatccgcctgcagccgcttgtaagagctgaacaggctgacgatattctgtactactataacaacattgcaggcgagagcccgcgctccaacttttttatcgttaccggcaacgagatactcaccgcgcaaaacaacgtgctgatgggcgttacgcggaaaaagatactgtcgttaaacgtccccggttacaccgttaccgcgcgtgattttacgctggaggatgtgtttaacgccagagaggcctttatcagcagcaccaccaggcaggcccacccggtagtgatcatcgacggcaagcccatcggcaacggccggccgggaccggtagtgcgcgaaatcaaccggcagctttttgagctgatggagcgggagtaa

SEQ ID NO: 234 - protein, 273 aa, Unknown
  Obtained from environmental sample
  DOMAIN (8)...(267): Aminotransferase class IV
MDRYIQINDQLISAAQATLGVTDLSIHRGYGIFDFFKTIGNRPIFLEDHLDRFFVSAHEMLLDVPYTREELRLMIARLTEKNNLPDSGIKIILTGGYADDGYTISGPPNLIMQQTPLVIKDFSDDGMRLITFHHQRQVPLAKSIDYVQAIRLQPLVRAEQADDILYYYNNIAGESPRSNFFIVTGNEILTAQNNVLMGVTRKKILSLNVPGYTVTARDFTLEDVFNAREAFISSTTRQAHPVVIIDGKPIGNGRPGPVVREINRQLFELMERE

SEQ ID NO: 235 - DNA, 906 bp, Unknown
  Obtained from environmental sample
atgactgacgaacgcaaagtatggctgaacggtgacctgatcccctgggagaaagccacggtaccgctgttgtcccatggattttcgcggggctcggcgatgttcgatgtgtttatggtgtacaacagccccgacggtcccaaggcgtttcgaatggaccagcacctcaagcggctccagcgcagtgcggatcttttggggatggagatggcctattcgaccgaggagatcatccaggcggtgaagacagcggtcaaggccaaccgcctcacgcagggcatcgtgaagattatggcctattggggggaggaggcgctcatcgacctggtcctgaagtccaagctcgacctggccattttcacgatcccccacgggggcaccccgggggtggacaagcccaagcccatctcggcctgcatcaccaaatggaaaaaaattcacccgctgagcgtcccggtggcggccaaggcctgctccaactacctgaacggctatctggcccgcaaggatgccaacagccgcgggttcgatgtggggctcatggcgggaaccgacggtttcatggccgagggatcgatcgaatcgttctttatcgtcaaggacggcgtgctcaaaacccctcatctgggcccgatcctttcgagcatcacccgcatgtcggtgctggaagcggcccctacaatagacatcccggttgcccaggaggcgcttacgcccgaggacctctacaccgcggatgagatcttcacgggccactcgagcgtcaaggtctccccggtcgagcggttcgaggaccggacgctcaaggcgccgggtccggtcacccgcaagctcatgaacctgatggacgatgtcatcgccttcaaggacaatcgttttccgcattggtttcaggcactcagctag

SEQ ID NO: 236 - protein, 301 aa, Unknown
  Obtained from environmental sample
  DOMAIN (10)...(283): Aminotransferase class IV
MTDERKVWLNGDLIPWEKATVPLLSHGFSRGSAMFDVFMVYNSPDGPKAFRMDQHLKRLQRSADLLGMEMAYSTEEIIQAVKTAVKANRLTQGIVKIMAYWGEEALIDLVLKSKLDLAIFTIPHGGTPGVDKPKPISACITKWKKIHPLSVPVAAKACSNYLNGYLARKDANSRGFDVGLMAGTDGFMAEGSIESFFIVKDGVLKTPHLGPILSSITRMSVLEAAPTIDIPVAQEALTPEDLYTADEIFTGHSSVKVSPVERFEDRTLKAPGPVTRKLMNLMDDVIAFKDNRFPHWFQALS

SEQ ID NO: 237 - DNA, 837 bp, Unknown
  Obtained from environmental sample
atgagagaaattgtttttttgactggagaatttcttgaaaaagaagcggctaaaatttctcccaatgataggggttttatttttgccgatggtgtttacgaagttgccaaatattacaatggacgcccttttcggtatgatgaccacttaaaaaggctggaacgcagtctttctgaacttgaaattgaatacccggaaactgaaaatcttcaatccgtttttaactcactcataaccagaaataaccttaatgataaacatgcaggggtatatttacaaattacacgcggagaacataaacgtgtgcatcatttccctgaaaatgttcagccaactgtttatgcttttgctttcgaattgccttccttcaaggaaaatcttgagaaaggaatcaaagtaattactcacgaagatattcgctggcaacgttgtgatataaaatcggtttcactgcttcccaatacaatgttgtataacaaagccgtaaaagccggggcgggagagtgcgttttaattcgcaatggaatggttaccgaagctacacattcaagcgttttgtgtgtaaaaaacggaattgttattacacgaccattatcaaatctgattcttcccggaattacaagaaaagttgtacaggagatatgctctgtccataatattgcttttgaagagcgcgaattttctgaaactgaattgcttgaaatggatgaaattataattgctggtacggggagtgaaataactccggcaatcaaggtaaacgaatcaactataggaaacggcaaaccaggcaaaatcacacggtttattcagcaaaagttttttgagatggtttaa

SEQ ID NO: 238 - protein, 278 aa, Unknown
  Obtained from environmental sample
  DOMAIN (8)...(275): Aminotransferase class IV
  SITE (1)...(4): Tubulin-beta mRNA autoregulation signal. Prosite id = PS00228
  SITE (257)...(260): N-glycosylation site. Prosite id = PS00001
MREIVFLTGEFLEKEAAKISPNDRGFIFADGVYEVAKYYNGRPFRYDDHLKRLERSLSELEIEYPETENLQSVFNSLITRNNLNDKHAGVYLQITRGEHKRVHHFPENVQPTVYAFAFELPSFKENLEKGIKVITHEDIRWQRCDIKSVSLLPNTMLYNKAVKAGAGECVLIRNGMVTEATHSSVLCVKNGIVITRPLSNLILPGITRKVVQEICSVHNIAFEEREFSETELLEMDEIIIAGTGSEITPAIKVNESTIGNGKPGKITRFIQQKFFEMV

SEQ ID NO: 239 - DNA, 843 bp, Unknown
  Obtained from environmental sample
atgaatgaaattgtttatttgaatggcgtatttatgccaaaagaagctgcaaaaatatcgccagacgatcgcggatttatttttgccgacggtgtttacgaagttgcaaaatattacaatggcaatccttttcggtttgaagatcatattctaaggctggaaagaagtctgcgggaacttgaaattgattatactgaaattgacggcttacaatctgtttttaatgagctgattaaaagaaataatttatttgataaacatgccggggtttatcttcagattacccgcggagtaaataaacgtgaacattattttcctgaaaatattaatccaacagtttacgcgtttgcatttgatttgccttcgtttaaaaataatcttgaaaatggaattaaagtaattactcacgaagatattcgctggctacgttgcgatataaaatctgtttcgcttttagcaaatacaatgctttataacaaagctataaaaaccggggcaggagaatgcatccttattcgcaacgggatggtaacagaggcaacacattcaagtgtattgggagttaaaaacggaatggtaattacatgtcctctttccaatttaattcttcccggaattacacgaaaagttatcatggaaatatgcactgcaggtaaaattccttttgaagaacgggaattttcagaaattgaaatgtacgatatggatgaaattataattgccggaaccggcagcgaaattactccagcaattcaggtgaacgataaaattattggaaacggcaatcccggaaaaataacccgctttattcaaaacagattttttgaaatggtgagagggtag

SEQ ID NO: 240 - protein, 280 aa, Unknown
  Obtained from environmental sample
  DOMAIN (8)...(275): Aminotransferase class IV
MNEIVYLNGVFMPKEAAKISPDDRGFIFADGVYEVAKYYNGNPFRFEDHILRLERSLRELEIDYTEIDGLQSVFNELIKRNNLFDKHAGVYLQITRGVNKREHYFPENINPTVYAFAFDLPSFKNNLENGIKVITHEDIRWLRCDIKSVSLLANTMLYNKAIKTGAGECILIRNGMVTEATHSSVLGVKNGMVITCPLSNLILPGITRKVIMEICTAGKIPFEEREFSEIEMYDMDEIIIAGTGSEITPAIQVNDKIIGNGNPGKITRFIQNRFFEMVRG

SEQ ID NO: 241 - DNA, 825 bp, Unknown; identical to SEQ ID NO: 183
  Obtained from environmental sample

SEQ ID NO: 242 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 243 - DNA, 825 bp, Unknown; identical to SEQ ID NO: 183
  Obtained from environmental sample

SEQ ID NO: 244 - protein, 274 aa, Unknown; identical to SEQ ID NO: 184
  Obtained from environmental sample
  DOMAIN (7)...(268): Aminotransferase class IV
  SITE (256)...(259): N-glycosylation site. Prosite id = PS00001

SEQ ID NO: 245 - DNA, 906 bp, Unknown
  Obtained from environmental sample
gtgttcaaacatgtcgatgcctatgccggtgacccgattctgtcgctgatggagaccttcaagaccgatccgcgtgccaacaaggtcaacctcagcatcggcctgtactacgacgcggccggcgtggtgccacaactggcagccgtgggcgaggcggagaagcgcctggccgacaagccccacgaagcctccctgtacctgccgatggaaggcctggccgggtaccgccaggccatccagaacctgctgttcggcgccgatcacccggcggtgaccagcggccgcgtcgccaccgtgcagacggtcggcggttccggcgcgctgaaggtcggtgccgacttcctcaagcgctatttccccgagtcgcaggtatgggtcagcaatccgacctgggacaaccaccgtgccatcttcgaaggtgccgggttcaaggtgaatacctacccgtacttcgaccaggcctcccgcggcgtcgacttcgacggcatgctggctaccctgcagaccctgccggccaacagcatcgtcctgctccacccgtgctgccacaaccccaccggcgtcgacctgacccaggcccaatggcagcaggtgatcgaagtggtcaaggcgcgcgagttgatcccgttcctcgacatcgcctaccagggcttcggcgaaggcctggtcgaggacgccttcgccatccgcgaggccgcccgtgccggcgtagcgtgcctggtcagcaactccttctcgaagatcttctcgctgtatggcgagcgggtaggggggctgtcggtggtctgcgacgatgcccagacccaggccagcgtactcggccagctcaaggccaccgtacgccgcaactactccagcccgcccaccttcggtgcgcaactggtggccacggtattgctcgtgccg

SEQ ID NO: 246 - protein, 302 aa, Unknown
  Obtained from environmental sample
  DOMAIN (26)...(302): Aminotransferase class I and II
  SITE (30)...(33): N-glycosylation site. Prosite id = PS00001
  SITE (247)...(260): Aminotransferases class-I pyridoxal-phosphate attachment site. Prosite id = PS00105
  SITE (287)...(290): N-glycosylation site. Prosite id = PS00001
MFKHVDAYAGDPILSLMETFKTDPRANKVNLSIGLYYDAAGVVPQLAAVGEAEKRLADKPHEASLYLPMEGLAGYRQAIQNLLFGADHPAVTSGRVATVQTVGGSGALKVGADFLKRYFPESQVWVSNPTWDNHRAIFEGAGFKVNTYPYFDQASRGVDFDGMLATLQTLPANSIVLLHPCCHNPTGVDLTQAQWQQVIEVVKARELIPFLDIAYQGFGEGLVEDAFAIREAARAGVACLVSNSFSKIFSLYGERVGGLSVVCDDAQTQASVLGQLKATVRRNYSSPPTFGAQLVATVLLVP

SEQ ID NO: 247 - DNA, 861 bp, Unknown
  Obtained from environmental sample
ttggacgcgctgggatactacaacggaaaatggggctcactggacgagatgaccgtgccaatgaacgacagaggctgctacttcggagacggcgtgtacgatgccgcctgcgcggctaacggagtaacctttgccctggatgagcacattgaccgttttttcaacagcgcagagctcctggaaataaaaatcaatttaacaaaagaggaactgaaaaaaaccctcaatgaaatgtgttccaaagtggataagggagtttacctggtttattggcaggtaacccgcggaacaggccggcgaaaccatgtatttcctgaaggcccatcaaatctctggattatgataaagccctatcccttatacgatctttatacaaaaataaagctcatcacaatggaagatacccgttttctccactgcaacattaagaccattaaccttattcccaatgtcattgcttcccagcgggcgctggaagcaggctgcgatgaaacggtatttcaccgcggcgaaacagtaaccgagtgcgcccacagcaatgtccacatcctcaaaaacggcaggtttatcacccatcaggcggacaatctgatcctccggggtattgcccgcagccatatattgcaagcctgcgacaggctgaaaatcccggttgacgaacgggagtttaccctttcggaattgtttgacgcggacgaggcgattgtgtccagcagcggtgatttctgcgtcagcgccgacacaatcgacgggaaaagcgtgggagggaaggcacctgaactgcttaaaaaaattcaggacgaagtgctgagggaatttaccgaagcaactggctatacgcctgagtggagtaaggcataa

SEQ ID NO: 248 - protein, 286 aa, Unknown
  Obtained from environmental sample
  DOMAIN (8)...(270): Aminotransferase class IV
MDALGYYNGKWGSLDEMTVPMNDRGCYFGDGVYDAACAANGVTFALDEHIDRFFNSAELLEIKINLTKEELKKTLNEMCSKVDKGVYLVYWQVTRGTGRRNHVFPEGPSNLWIMIKPYPLYDLYTKIKLITMEDTRFLHCNIKTINLIPNVIASQRALEAGCDETVFHRGETVTECAHSNVHILKNGRFITHQADNLILRGIARSHILQACDRLKIPVDEREFTLSELFDADEAIVSSSGDFCVSADTIDGKSVGGKAPELLKKIQDEVLREFTEATGYTPEWSKA

SEQ ID NO: 249 - DNA, 837 bp, Unknown
  Obtained from environmental sample
atgagcacagccgacccactcaccaagataatcccggccgaggccgccgattggccggttgtcctggatggggagctgatgcgggccggcgaggcgatgatccccgccggtgacgatggactgatccgaggcgacggcgcgttcgatgccttcccggtcgtggacggtcgcccgttcgcccgggcggcacatctggatcgcctcgagcgctcgtgcgcggcgctggacctgccgtgcccccgcgcgcagatcgagtccgacatcgacctgctgctgacccgggccggggacggctacctagcggtccgggtgctgctcacgcgcggcgggcaccggatctgccgcttggagccgcgcggcgagatatcggagctgaccaagccggtgcgcctgctgccggtcacctacaacccatcggtggtgctcaacggcgtcaagtcgctctcctacggggcaaacatgctggcctcgcggcgggcggtggccgccggctatggcgaggcgctgctggttcgctcggacgggatcgtgctcgagggacccacgtgctcgatcttctgggtacgcgatggccgccttcagacccccgcgctcgagaccgggatcctcgcctcgatcacccggcgggtgatcctcgagagcatggcggtcgaggagggcagcttctcgcttgagcacgcgctcggtgccgacgaggcgttcctggtctcgaccgcccgactcgggcagccgatcgccgcgatcggcgaggtgaccctgccctcggcgcccggcccgcagaccctcaaggcgcaggaagcgatcgcccgcgccatggccgagggctcgatcgcctga

SEQ ID NO: 250 - protein, 278 aa, Unknown
  Obtained from environmental sample
  DOMAIN (23)...(269): Aminotransferase class IV
MSTADPLTKIIPAEAADWPVVLDGELMRAGEAMIPAGDDGLIRGDGAFDAFPVVDGRPFARAAHLDRLERSCAALDLPCPRAQIESDIDLLLTRAGDGYLAVRVLLTRGGHRICRLEPRGEISELTKPVRLLPVTYNPSVVLNGVKSLSYGANMLASRRAVAAGYGEALLVRSDGIVLEGPTCSIFWVRDGRLQTPALETGILASITRRVILESMAVEEGSFSLEHALGADEAFLVSTARLGQPIAAIGEVTLPSAPGPQTLKAQEAIARAMAEGSIA

SEQ ID NO: 251 - DNA, 135 bp, Unknown
  Obtained from environmental sample
atgaaggtcatcgtgcttggcagcggcgtcatcggcgtgaccagcgcctggtatctggccgaggccggccacgaggtggtcgtgctcgaccgccagcccggcccggcgctcgagacgagcttcgccaacgccggc

SEQ ID NO: 252 - protein, 45 aa, Unknown
  Obtained from environmental sample
MKVIVLGSGVIGVTSAWYLAEAGHEVVVLDRQPGPALETSFANAG

SEQ ID NO: 253 - DNA, 1260 bp, Unknown
  Obtained from environmental sample
atgacgggccgaaccgcggacgggacggtgatcgtcgtcggtgcggggatcgtcgggatcgcctgtgcgcactacctgcgcgaggcgggactcacggtgacggtgatcgaccgggggacgatcgcaggcgcgtgctcgcatgccaactgcggtctgatctgtcccagccacctgttgccgctgacgcatccgggcgctgttcgtgccgcgttgaagtcgttgttcacgccgcacgctccgtttcggatccagccacggctgagtccggcgctgtggtcgtggctgtggcacttcgcccgccggtgcaatcaccgtcagatgctgaccgccgcggggcatctcaaggcgatcctcgaatcgtctatggttgagtatcggcgactggttcccgcgcagcccctcgagtgcgaatggaaggagagtggactgctgaacgtgctcttgaccgaccgtggcatgcacgcgttcgccgaggaggaccggctgatcagcgagcacttcggcctgtccgcacggcggatcgaggggagcgaactgccggcgttcgacccggccctcaagccgggcctggcgggggcgttctactacgagggggacgcttcgctccgccccgaccgcttgaacgcaagctgggccgcgcggttgcgggagcggggagtaaggttcctcgagcagtgcgagatgcagcggatcgtcacttcgggaggacggattacgacgctgcagacgctgcagggagagatggccgcgcagttcgtcgtcatcgcgacgggtgcctggagctgccggctggcgcgcgacctcggctgccggattccggtgcagcccggcaaagggtactcggtgacgatggcccggcccgagccctgtccgaggtttccgatgctgttccccgagcaccgcgtcgccgtctcgccattcgaacaggggtatcgcctcggttcgatgatggagttcgccggcttcgatacgtcgattcgaccgcagcggatcgagcagttacgaacatcggcagagccctacctggtggcaccttacaccgaagtcgagcacgaacgatggtacggctggcggccgatgacgtgcgacagcctgccgatcatcggccgggtgcccgctctggagaacgcgtacctggcgaccggccacaacatgctgggtgtcagtctcgcccctgcgaccggccgactcatcgccgagatcgtcaccggcgtgccgccgcatgtcgacccggcaccctacagtgcaaaccggttctga

SEQ ID NO: 254 - protein, 419 aa, Unknown
  Obtained from environmental sample
  DOMAIN (9)...(401): FAD dependent oxidoreductase
  SITE (211)...(214): N-glycosylation site. Prosite id = PS00001
MTGRTADGTVIVVGAGIVGIACAHYLREAGLTVTVIDRGTIAGACSHANCGLICPSHLLPLTHPGAVRAALKSLFTPHAPFRIQPRLSPALWSWLWHFARRCNHRQMLTAAGHLKAILESSMVEYRRLVPAQPLECEWKESGLLNVLLTDRGMHAFAEEDRLISEHFGLSARRIEGSELPAFDPALKPGLAGAFYYEGDASLRPDRLNASWAARLRERGVRFLEQCEMQRIVTSGGRITTLQTLQGEMAAQFVVIATGAWSCRLARDLGCRIPVQPGKGYSVTMARPEPCPRFPMLFPEHRVAVSPFEQGYRLGSMMEFAGFDTSIRPQRIEQLRTSAEPYLVAPYTEVEHERWYGWRPMTCDSLPIIGRVPALENAYLATGHNMLGVSLAPATGRLIAEIVTGVPPHVDPAPYSANRF

SEQ ID NO: 255 - DNA, 1233 bp, Unknown
  Obtained from environmental sample
atggaattcgataccgtcgtgctcggcgcgggcattgtcggcgtgtcggtggcggtgcatcttcagaaacgcggccgtcaggtcgcactggtcgaccgcaagcagcccggcaacgaaacgtcgttcggcaatgccgggctgatccagcgtgaaggcgtctatccgtacgcgtttccgcgcgacctcggcaccttgcttcggtacgcgcgcaaccagtcgccggacgttcgctaccatgctgacgccatactcaagaccgcgccctttctttggcaatactggcgcaattctcatccggcaaaacacgcggctatcgcgaggtcgtacgcaacactgatcgagcattgcgtggacgaacaccgcgcgctggcggccgaggccggcgcgagcgcgttattgcgcccaaccggctggatcaaggtgttccgcacggcggccgtgtgggacgaagaaatccggcatgctgaacagtggcaccgggaatatggcgtcgaattcgaatcgctggatgcgggccggctgcaacagaaggagcccgatctcgacaagaccttgttaggcggcctgcgttatacggaatccgaatccgtaagcgaccccaacgcgctggtcaccgcctacgcaaagtatttcgaaacgctcggcggacgcttcttaatcggcgacgccgactcgtttcgtgaaggttggacggtcgacacgcaagacggagccatcaccgcttcgtcggcggtcgtcgcgttgggaccgtggtcggatcgtgtgagcgcgcggctcggctatcgcttgccgctcgccgtcaaacgcgggtatcacatgcactatgcgccgcagggggcagcccgtctgaatcatccggttctggacgtcgagaagggctacgtgctggcacccatggcaaaaggcatccgtttgactacgggtgcggaaatcgcgcactgcgacgcgcctaaaacacccacgcaactcgccgcggtcgaaccggttgcgcgcacgctgtttccattgggcgagcgcctcgacaacgaggcgtggatgggacggcgcccctgcacgcccgacatgatgccgatcatcggacccgccggaaatcacaaggacctgtggttcgcgttcggccatgcgcaccatgggctgacgctcggccccgtcacgggccggctgatcgccgagatgatgacccacgaggaaacgctcgtggacacgcggccgttcagggtggagcggttctaa

SEQ ID NO: 256 - protein, 410 aa, Unknown
  Obtained from environmental sample
  DOMAIN (4)...(392): FAD dependent oxidoreductase
  SITE (38)...(41): N-glycosylation site. Prosite id = PS00001
MEFDTVVLGAGIVGVSVAVHLQKRGRQVALVDRKQPGNETSFGNAGLIQREGVYPYAFPRDLGTLLRYARNQSPDVRYHADAILKTAPFLWQYWRNSHPAKHAAIARSYATLIEHCVDEHRALAAEAGASALLRPTGWIKVFRTAAVWDEEIRHAEQWHREYGVEFESLDAGRLQQKEPDLDKTLLGGLRYTESESVSDPNALVTAYAKYFETLGGRFLIGDADSFREGWTVDTQDGAITASSAVVALGPWSDRVSARLGYRLPLAVKRGYHMHYAPQGAARLNHPVLDVEKGYVLAPMAKGIRLTTGAEIAHCDAPKTPTQLAAVEPVARTLFPLGERLDNEAWMGRRPCTPDMMPIIGPAGNHKDLWFAFGHAHHGLTLGPVTGRLIAEMMTHEETLVDTRPFRVERF

SEQ ID NO: 257 - DNA, 1233 bp, Unknown
  Obtained from environmental sample
atgaaaagtgcaatcgtactcggcgccggaatggtggggatcgcgaccgcggtgcacctgcagcggcgcggctggtcggtcgtggtcgtcgaccgcagggagccggggcaggagaccagctacggcaatgccggtttcatccagagcgaggcacgccggccctatccgatgccgaccgacctgttgtcgctgctcgacatcgtcaccgggcgcagcaatgacgtgcactatcggctcgcctcgctgccgcgccacatcggcccactggtccggtactggtggaattcccttcccgcgcgacacgaccggatctcggccgactacgcacggatcatcgccaaggccgacagcgagcacggcgatctgatccgtgcctccggcgcggacaatctggtgcgccgcgacggctaccgggttctctaccgcgatcaggccgcgctggacgagggcgtggcggaggcggaagcgctgcgcgccgcgtacggcatcggctttcgcgccatgtcggccgccgaattcgccaaggccgagccgggattgatcaatcccggcgtgggcgcggtgcattggctcgagccgtggacggtctccgagcccggcgcactggtcgccgcctatgcgcatctgttcgagcgtttggggggcaccatcgtgcgcggtgatgccgaaaccctgacccagtctggcaaggggtggacggtgacgtcggctgccggccggctcgaggccgaggcggtcgtggtcgcgctcgggccatggtcgccaaaattcctgcgccgtttcggctacgggattccgatggtggaaaagcgcggctatcaccggcactatgcgggcggtcaaaagctcgatctgccgttgcgggacgccgccttcggctatgtgatggcgccgatgaccaaggggctgcgcctgaccaccggtgccgagctctctgcgcccgacgccaagccgacaccggtccagctgatgcgcgcggaggccgccgcgcgcgaactgctcgacatcggcaagcccgtggaggtcgaaccgtggctcggcacgcgtccctgcatgccggacatgctgccggtcgtcggccgcgcggcgcggcacgaggggctgtggctgcatttcggacacgggcaccaaggctttaccctcggtccgaccacggggcgcatgctcgccgaactgatgagcggcgaacagccggtcgtagacgctaccgcgtttcgccccgatcgcttctga

SEQ ID NO: 258 - protein, 410 aa, Unknown
  Obtained from environmental sample
  DOMAIN (3)...(392): FAD dependent oxidoreductase
MKSAIVLGAGMVGIATAVHLQRRGWSVVVVDRREPGQETSYGNAGFIQSEARRPYPMPTDLLSLLDIVTGRSNDVHYRLASLPRHIGPLVRYWWNSLPARHDRISADYARIIAKADSEHGDLIRASGADNLVRRDGYRVLYRDQAALDEGVAEAEALRAAYGIGFRAMSAAEFAKAEPGLINPGVGAVHWLEPWTVSEPGALVAAYAHLFERLGGTIVRGDAETLTQSGKGWTVTSAAGRLEAEAVVVALGPWSPKFLRRFGYGIPMVEKRGYHRHYAGGQKLDLPLRDAAFGYVMAPMTKGLRLTTGAELSAPDAKPTPVQLMRAEAAARELLDIGKPVEVEPWLGTRPCMPDMLPVVGRAARHEGLWLHFGHGHQGFTLGPTTGRMLAELMSGEQPVVDATAFRPDRF

SEQ ID NO: 259 - DNA, 1254 bp, Unknown
  Obtained from environmental sample
atgcacgtagtcatcctcggcagcggcgtcatcggcaccacgatggcgtactacctcgcacgcgatggtcatcgggtgacggtcatcgaccgccagcccgggccgggcctggagaccagctatgcgaatgccggcgaggtgtcgcccggctattcggcgccgtgggccggtcctggcgtgccgatcaaggcaatcaagtggatgctgatgcaccacagcccgctggtgatcaagccgatgctcgacccggccatgtggcgctggggtctgtcgatgttgcgcaactgcaccgaggcacgctatcgcctgaataagagccggatggtgcgcgtggccgaatacagccgcgactgcctgaaagcgctgcgcgccgagaccggcatccgctacgacgagcgcgcccagggcacgctgcagctcttccgcacacagaagcagctggacggcgtgggcaaggacatcgagatcctcaagcagtacggcgtgcccttccaggtgctcgaccgggcgggctatctcgaacacgagccggccctcgcgctggtcaaggaaaagttcgtcggagccctgcggctgcccggcgacgaaaccggcgactgtttcaagttcacccaggccctcgccgaacaggcgcgcgcgttgggcgtcgattttcgcttcggcaccacgattcacggcatcgacgccgccgacggcaagatccgcggcatcgacaccgacagcggccgcgtgacggctgaccattacatcgtcgcgctgggcagctactcgacccgcctgctcaagccgctcggtatcaagatcccggtatatccggtcaagggcttctcgatcaccgtgccgatctccgacgcggcacacgcgccggagtccacgatcatggacgaaacccacaaggtcgcggtcacgcgcctgggcgatcgcatccgcgtgggcggcacggcgcagctgtccggctttgacttgcaactcgacgctgggcgccgcaagacgctcgaattcgtcgtcggtgacctgttcccgcgcggcggtgacgtcgcccaggcggaattctggaccgggctgcgtccgatgacccccgacggcacgccgatcatcggcagaacgccctaccccaacctgaccctgagcaccggccacggcacgctcggctggacgatggccgccggcaccggacgcctggtcgccgaccttgtaagtggccgcacgcctgcaatccgcgtcgacgacctcgcagtcgaccgctacgcctaa

SEQ ID NO: 260 - protein, 417 aa, Unknown
  Obtained from environmental sample
  DOMAIN (2)...(398): FAD dependent oxidoreductase
  DOMAIN (2)...(351): Pyridine nucleotide-disulphide oxidoreductase
  SITE (96)...(99): N-glycosylation site. Prosite id = PS00001
  SITE (105)...(108): N-glycosylation site. Prosite id = PS00001
  SITE (378)...(381): N-glycosylation site. Prosite id = PS00001
MHVVILGSGVIGTTMAYYLARDGHRVTVIDRQPGPGLETSYANAGEVSPGYSAPWAGPGVPIKAIKWMLMHHSPLVIKPMLDPAMWRWGLSMLRNCTEARYRLNKSRMVRVAEYSRDCLKALRAETGIRYDERAQGTLQLFRTQKQLDGVGKDIEILKQYGVPFQVLDRAGYLEHEPALALVKEKFVGALRLPGDETGDCFKFTQALAEQARALGVDFRFGTTIHGIDAADGKIRGIDTDSGRVTADHYIVALGSYSTRLLKPLGIKIPVYPVKGFSITVPISDAAHAPESTIMDETHKVAVTRLGDRIRVGGTAQLSGFDLQLDAGRRKTLEFVVGDLFPRGGDVAQAEFWTGLRPMTPDGTPIIGRTPYPNLTLSTGHGTLGWTMAAGTGRLVADLVSGRTPAIRVDDLAVDRYA

SEQ ID NO: 261 - DNA, 1248 bp, Unknown
  Obtained from environmental sample
atggcagcggatgcaatcgtcctgggcgcaggcatcataggggtttcgacggcgctacaattggcgcggcgcggcaagtcggtcgtccttgtcgatcgtagggggccgggggaagagacatcctacgggaatgccgggctcatccagcgagagggcgtcgtcccttacgggttcccgcaacagttcggcctgatcctgcgctacgccttgaacaaccgtatcgatgctcactatcactggcgcgccatcccgcatgtcacttccttcctcgcgaagtactggtggcattccaacctcagccggcatcagctgatcgcacgcgcctacgctcccctgattgagcactcgatctccacccacaacgagctgatagaagaagctggtgcacaggacctcatcgccaggaatggctggactgaactcttccgcacctccgcaaagcgcgatggcgagttgaaggaagcggcacggctgcgccaggagtatggagtcactttccgggagctgacctcagccgacataaacgtagaggagcccgatatcagcggcgacttcgtcggcggcctgaagtgggaagatccgtggtccgtccgcgacccctatgcgctgaccatggcctatgttcgcctgttcgagaaactcggtgggcgggtcctcaagggtgatgcccgcagcctgtcgcagacggcgaccggctggcgcatggttgccggagaaggaaccgtcgaagcaaaggatgtggtggttgcgctcggcccctggtccgacaccgtgacgaagcccctcggctaccgcttcctcgtcggcgtcaagcgtggctatcacatgcactacggaaccagggtgggcgcaaagctcaatggctggaccatggatgcggagaagggctatttcctcgcgccgatgaaccagggtatccgcctgaccaccggagctgaattcgcgcttcgcgatgcccgcaagacaccggtccagctggagcgggcagaagcggtcgcccgcacggtcttcccgcttggcgagcgcctggacccggaaccttggatgggtgcacgcccctgcacgccggacatgatgccggtcatcggtcaggcgccgcgtcacaaaggcctctggttcgccttcggccatgcccaccacggcctgacgctcggcccggtgaccggtcaggtcatcgcggaagccattgcgggagaacagaccctcatcgacatctcggcctaccggcccgagcgcttcggggcctga

SEQ ID NO: 262 - protein, 415 aa, Unknown
  Obtained from environmental sample
  DOMAIN (4)...(395): FAD dependent oxidoreductase
  SITE (99)...(102): N-glycosylation site. Prosite id = PS00001
MAADAIVLGAGIIGVSTALQLARRGKSVVLVDRRGPGEETSYGNAGLIQREGVVPYGFPQQFGLILRYALNNRIDAHYHWRAIPHVTSFLAKYWWHSNLSRHQLIARAYAPLIEHSISTHNELIEEAGAQDLIARNGWTELFRTSAKRDGELKEAARLRQEYGVTFRELTSADINVEEPDISGDFVGGLKWEDPWSVRDPYALTMAYVRLFEKLGGRVLKGDARSLSQTATGWRMVAGEGTVEAKDVVVALGPWSDTVTKPLGYRFLVGVKRGYHMHYGTRVGAKLNGWTMDAEKGYFLAPMNQGIRLTTGAEFALRDARKTPVQLERAEAVARTVFPLGERLDPEPWMGARPCTPDMMPVIGQAPRHKGLWFAFGHAHHGLTLGPVTGQVIAEAIAGEQTLIDISAYRPERFGA

SEQ ID NO: 263 - DNA, 1254 bp, Unknown
  Obtained from environmental sample
atgagggtggtcatcgtaggaagcggggtcatcggcgtgacctcggcgtggtacctggctcgcgcgggccatgaggtcaccgtgctggaccgccagtccggtccggcgctcgaaacaagcttcgccaacgcgggggaagtatcccccggctactcgtctccctgggcaggccccggggtgccgctgaaggcgatcaagtggctcctaatgaaacacgggccgctggcgatccgcccacgtctcgaacccgcgatgtggtcttggatcctgaagatgctgtcgaactgcacctcgcagcgatacgcggtaaacaaggcacgcatggtgcccatcgcggaatacagccgcgactgccttcgcgagctgagaacgacgaccggaatcgaatacgacgaacggtcacgtggcaccctgcagctctttcgcacgcagaagcagctcgacgggatcgtcagcgacatcgaggtcctgaagcagttcggggtcgaatacacggtccttgccgcctcgggctgcgtcgccgcggaacccgcgctcgagcgcgtgagccacaagatcgtcgggggcctccggtttcctgacgacgagacaggagactgtcgagttttcacggaaaagctggcggtgctcgcgtccgccgctatcgacttccgctacggtgtcgccgtcgatggtctcgttcaggaacgcggcaaggtttcggctgtccgcacggcgaaagaggtgttcgccgccgatgcggtcgtcatcgcggcggggagctattcgccacgcttgctgaagcccatgggcgtccgcattccggtctacccggtcaagggctactcgctgacgttcccgatcgcggacgaggctgccgcgcctgtgtccacggtgatggacgagacctacaagatcgccatcacgcggcttggagaccggatccgggtgggcggcacggccgagatttccggcttcgatctctccctgccacgctcgcgccgtgcaccgctcgaacattcggttacggacctgtttccagaagccggactcgccagcgaagcctccttctggtgtggcctcaggccgatgaccccggatggccccccgatcgtgggcgccacgtcggtgcccggccttttcgtcaataccgggcatggcaccctcggatggacgatggcctgcggttccggacggatcctcgccgatatcgtgtccggaaggattccagagatcgacgtgaccgacctcggtccgggacggtaccgatcatga

SEQ ID NO: 264 - protein, 417 aa, Unknown
  Obtained from environmental sample
  DOMAIN (2)...(397): FAD dependent oxidoreductase
  SITE (96)...(99): N-glycosylation site. Prosite id = PS00001
MRVVIVGSGVIGVTSAWYLARAGHEVTVLDRQSGPALETSFANAGEVSPGYSSPWAGPGVPLKAIKWLLMKHGPLAIRPRLEPAMWSWILKMLSNCTSQRYAVNKARMVPIAEYSRDCLRELRTTTGIEYDERSRGTLQLFRTQKQLDGIVSDIEVLKQFGVEYTVLAASGCVAAEPALERVSHKIVGGLRFPDDETGDCRVFTEKLAVLASAAIDFRYGVAVDGLVQERGKVSAVRTAKEVFAADAVVIAAGSYSPRLLKPMGVRIPVYPVKGYSLTFPIADEAAAPVSTVMDETYKIAITRLGDRIRVGGTAEISGFDLSLPRSRRAPLEHSVTDLFPEAGLASEASFWCGLRPMTPDGPPIVGATSVPGLFVNTGHGTLGWTMACGSGRILADIVSGRIPEIDVTDLGPGRYRS

SEQ ID NO: 265 - DNA, 747 bp, Unknown
  Obtained from environmental sample
ccggcctcccaggtctacgtcagcaacaagcaccgcgcctgcgaacaggccggcattcgctcttttcagcaccctttgcccagcgacaccagccagcaggcgctcgagaaactgatcgatgagctcaatgccgatccaagcgtcgacggcatcctgttgcaactgccgctccctgcccacctggattcaaggccgattctcgaacgcattttaccccacaaggacgtggatggtttccacccctacaatctcggacgcctggctcagcggctgccggttctgcgcccctgcacccccaaggggatcatgaccctgctgcaggcgagcggcctcaaggtacgcggcctggacgccacggtggtgggcgcttccaatatcgtcggtcgcccgatggcattggaactgatgctcgccgggtgcaccaccacggtgtgccatcgcttcacccgtgacctggaagcgcacgtgcgccgtgccgaactgctggtcgtggcggtgggcaagccggggctggtcaagggcgaatgggttcgcgagggggccatcgtcatcgacgtggggatcaatcgcgaggaggatggacgcctggtcggcgatgtggagttcgcccctgcctcacagcgcgccgcctggattaccccggttcccggcggggtggggccgatgaccgtggcgtcattgctggaaaataccctttatgccgcggaacgccatgatgccatggagcaggagcgggtcgtcctttaa

SEQ ID NO: 266 - protein, 248 aa, Unknown
  Obtained from environmental sample
  DOMAIN (1)...(77): Tetrahydrofolate dehydrogenase/cyclohydrolase, catalytic domain
  DOMAIN (80)...(239): Tetrahydrofolate dehydrogenase/cyclohydrolase, NAD(P)-binding domain
  SITE (219)...(227): Tetrahydrofolate dehydrogenase/cyclohydrolase signature 2. Prosite id = PS00767
PASQVYVSNKHRACEQAGIRSFQHPLPSDTSQQALEKLIDELNADPSVDGILLQLPLPAHLDSRPILERILPHKDVDGFHPYNLGRLAQRLPVLRPCTPKGIMTLLQASGLKVRGLDATVVGASNIVGRPMALELMLAGCTTTVCHRFTRDLEAHVRRAELLVVAVGKPGLVKGEWVREGAIVIDVGINREEDGRLVGDVEFAPASQRAAWITPVPGGVGPMTVASLLENTLYAAERHDAMEQERVVL

SEQ ID NO: 267 - DNA, 1254 bp, Unknown
  Obtained from environmental sample
atgaagatcgcggtattgggcagtggcatcattggaacagcgacggcctggtggcttagccaggccggccacgaggtggtggtggtcgaccggcagctgcaggccggcatggaaaccagccgggccaacggcgcccagatctcggtgtcctatgcggaaccctgggccaatccgcaggttttcggcaagctgctgaagtggctggggcgcgacgatgcgcccttgtcgttcaagccgcaagccgatctccgccagtggttgtgggggctgatgttcctgagggaatgtttcccctcgcgcgtatcgcgcaatgtcagtgcgctggtcgcgatggccgaatacagccggcgaacgctacaggaaatgcggcgcgacctaggtattgcatacgatcaccaagagcgcggcatcctcaacttctaccgcagcggtgcagagttcgaacagtctcagaagctcgccgagattatgcgcgactacggcgtcgatcgccgcattgtgagcgccgatgaagtgaccaccatcgaacccgcgctggcgccttcgcgccatgccattgtgggcggcgactatacgcccgaagacgaatccggcgacgccttcctctttactcaggagctcgcgcgacgcgcagcagcagcgggcgtggagtttcgctatggcacgcaattgagccgttttattggcgtgggcgggcgtgtcgaggcagcagagttgatcgacgctaacggagagtacgagctgctccgggcggatgcctacgtcgcggcgttgggctcccatacaccggcgtatgtcacccccttgggtgtgcgttgcccggtctacccggccaagggttattccgctacgttcgatatcgtggatgccgacgcagcaccatttgtcagcctgaccgacagcgagcacaaggtggtgtatacacgcctgggatcgcgcctgcgcatggccggcacggccgagcttggcggctattcgcgcgccctgaataccgcacgttgtgagcagatgtctcgcctcgctcgcgagttgttcccaagcgccctcgattttgataatgtacgttattggtcggggttgcgacccgcgaccccctccaacgtccccctcattggtcggacccggatttccaatctttatctgaacacgggccacggtacgctcggctggaccatgggtgtcggctcaggcaaggcactggcggatctcatcagcggccaccgccccgaacccgaatttccatttctggattga

SEQ ID NO: 268 - protein, 417 aa, Unknown
  Obtained from environmental sample
  DOMAIN (2)...(403): FAD dependent oxidoreductase
  SITE (105)...(108): N-glycosylation site. Prosite id = PS00001
MKIAVLGSGIIGTATAWWLSQAGHEVVVVDRQLQAGMETSRANGAQISVSYAEPWANPQVFGKLLKWLGRDDAPLSFKPQADLRQWLWGLMFLRECFPSRVSRNVSALVAMAEYSRRTLQEMRRDLGIAYDHQERGILNFYRSGAEFEQSQKLAEIMRDYGVDRRIVSADEVTTIEPALAPSRHAIVGGDYTPEDESGDAFLFTQELARRAAAAGVEFRYGTQLSRFIGVGGRVEAAELIDANGEYELLRADAYVAALGSHTPAYVTPLGVRCPVYPAKGYSATFDIVDADAAPFVSLTDSEHKVVYTRLGSRLRMAGTAELGGYSRALNTARCEQMSRLARELFPSALDFDNVRYWSGLRPATPSNVPLIGRTRISNLYLNTGHGTLGWTMGVGSGKALADLISGHRPEPEFPFLD

SEQ ID NO: 269 - DNA, 1299 bp, Unknown
  Obtained from environmental sample
atgcgcgtactggtccttggaggtggtgtcatcggtgtctgcagcgcctactacctggcgcgcgcgggcttcgaggtggaactggtggatcgccagccgggcccggcgctggaaaccagctttgccaacgccgggcagatttcccccggctacgcctcgccctgggcggcgccgggcgtgccgctcaaggccatcagatggctgttccagcgccatgccccgctggccgtgcgcttcaccgccgaaccggcccagtacctgtggatgctgcgcatgctgcgcaactgcacggcgagccgctacgccctgaacaaggagcgcatggtgcgcctggccgagtacagccgcgactgcctggacgagctgcgcgccgagaccggcatcgcctacgagggccgccagctgggcaccacccagctgttccgcacccaggcgcagctggacgcggcggccaaggacatcgaggtgctggagcgcagcggcgtgccctacgaactgctggaccgcgccggtatcgcccgggtcgagccggcgctggcggcggtggccgaacgcctgagcggtgccctgcgcctgcccaatgaccagaccggcgactgccagctgttcaccacgcgcctggccgaactggcgcgcgggctgggcgtggaattccgcttcggcagccaggtgcagcgcttcgagctgcagcgcggacgcatcgccggcgtgtggatcgacggcaggctggtcaccgccgaccgctacgtgctggccctgggcagctacagcccgctgctgctgcgccccctgggcatccgcctgccggtctatcccctcaagggctactcgctgaccgtgccgatcgacaatccggacgccgcgccggtgtccaccgtgctggacgagacctacaaggtggccatcacccgcttcgaccagcgcatgcgcgtcggcggcatggcggagatcgccggctacgacctgcgcctgaatccgcgccggcgccagaccctggaaatggtcacccatgacctgtatcccggcgccggcgagctgtcccgggccgagttctggaccggcctgcgcccggccaccccggacggcaccccggtggtgggcgccacgcccttcgacaacctgttcctcaataccggccacggcaccctcggctggaccatggcctgcggttccggccgcctgctggccgacctgctggcgcgccagcggccgcagatccgcagcgagggactggatgtctaccgctatctgcccggcggccttcactccgctcaggccagggatgcggtgtcggcttag

SEQ ID NO: 270 - protein, 432 aa, Unknown
  Obtained from environmental sample
  DOMAIN (2)...(398): FAD dependent oxidoreductase
  SITE (96)...(99): N-glycosylation site. Prosite id = PS00001
MRVLVLGGGVIGVCSAYYLARAGFEVELVDRQPGPALETSFANAGQISPGYASPWAAPGVPLKAIRWLFQRHAPLAVRFTAEPAQYLWMLRMLRNCTASRYALNKERMVRLAEYSRDCLDELRAETGIAYEGRQLGTTQLFRTQAQLDAAAKDIEVLERSGVPYELLDRAGIARVEPALAAVAERLSGALRLPNDQTGDCQLFTTRLAELARGLGVEFRFGSQVQRFELQRGRIAGVWIDGRLVTADRYVLALGSYSPLLLRPLGIRLPVYPLKGYSLTVPIDNPDAAPVSTVLDETYKVAITRFDQRMRVGGMAEIAGYDLRLNPRRRQTLEMVTHDLYPGAGELSRAEFWTGLRPATPDGTPVVGATPFDNLFLNTGHGTLGWTMACGSGRLLADLLARQRPQIRSEGLDVYRYLPGGLHSAQARDAVSA

SEQ ID NO: 271 - DNA, 1239 bp, Unknown
  Obtained from environmental sample
gtgaagcccacctccatcctcgtcctcggtgccggcatggtcggcacttgcaccgccctgcacctggcgcagcgcggccaccacgtcaccctggtcgaccgccgcgagcccggccgcgagacctcctacggcaacgccggcatcatccagcgcgaggcggtggagccgtatgcctttccgcaggactggtccaccgtgctgcgctttgccatgaagcgcggggccgaggtcaactaccacctcggcgcgctgccggtgcaggcgccggcgctggcgcgctactggtcccactcgcggcccgaccgccatgcccgcatcgccgtggcctacggccgcctcatcgagcattgcctcgtggagcaccagcggctgatcgagctgtcgtcggccgatgacctggtcaagcgcgagggctaccgcttcgtgctgcgcgaggccgcgtcgttcgagcaggcggccgcgcgcgccgagcgcctgtcgaaggcacacgggctgcgccacgtgctgatggacggcgatgccttggcgcaggccgagcccggcctgaagcggcggctggccggcgccatccactggctggacccgtggaccgtgagcgatccgggcgcgctggtgggccgttatgcggcatcgctggagcgcgcgggcggccgcgtgctgcacggcgatgcgtccacgctgcgccagaccggcgcgctctggcaggtgcagaccgagtccggcgtggtggacgccgagcaggcggtgatcgcgctgggcccgtggtccgagggcttgctcaagccgctgggctatcgctaccccttgttcgtcaagcgcggctaccaccgccattaccgcggcggcacgggcccgcgcctgccggcctacgacctcgacagcggcctggtgctggcccccatgaagctgggcgtgcgcctcaccaccggcgccgagtttgcgctggtcgatgcgcccgcgacaccggtgcagctggggcgtgccgaggtgctggcgcgcgagttgttcgacctgcccgagccggtcgaggccgagccctggaagggcgcgcggccctgcagcgccgacatgctgccggtgatcggcgcggcgccgaagcacaagggcctgtggttcaacttcggccacgcgcaccagggcttcacgctgggcccggtgagcggccggctgatgaccgagctgatcgaaggcggcccgacggtggtggacccggcgccttatgcgccgtcgcggttctga

SEQ ID NO: 272 - protein, 412 aa, Unknown
  Obtained from environmental sample
  SIGNAL (1)...(22)
  DOMAIN (5)...(394): FAD dependent oxidoreductase
MKPTSILVLGAGMVGTCTALHLAQRGHHVTLVDRREPGRETSYGNAGIIQREAVEPYAFPQDWSTVLRFAMKRGAEVNYHLGALPVQAPALARYWSHSRPDRHARIAVAYGRLIEHCLVEHQRLIELSSADDLVKREGYRFVLREAASFEQAAARAERLSKAHGLRHVLMDGDALAQAEPGLKRRLAGAIHWLDPWTVSDPGALVGRYAASLERAGGRVLHGDASTLRQTGALWQVQTESGVVDAEQAVIALGPWSEGLLKPLGYRYPLFVKRGYHRHYRGGTGPRLPAYDLDSGLVLAPMKLGVRLTTGAEFALVDAPATPVQLGRAEVLARELFDLPEPVEAEPWKGARPCSADMLPVIGAAPKHKGLWFNFGHAHQGFTLGPVSGRLMTELIEGGPTVVDPAPYAPSRF

SEQ ID NO: 273 - DNA, 1257 bp, Unknown
  Obtained from environmental sample
atgaaccctacgcatagcgacgcgctcgtccttggcggcggcgtcatcggtctttcctgcgccctgtacttgttgaagtccggcgcctcggtccgagtgctcgagcagggcacggcgggctgcggcagctcgcacggcaactgcggaaccctgacgccgagccatgccgcgccactggcgatgccgggcatgatcggccaggcgctgcgctggatgctcaagcgcgacgcgcccctctacgtcaacccgaagcccgacctcgcgcgcctgcgctggctgctcggtttcgcgcggcgctgcaactggcgcgacttcacccgggccgccgacgcccgcgcggcgatcctgcaacgctcgcgcggcctgatcgaggaactggtgggcagcgaaggcctcgattgcgagttcgccaacggcggcgcgctgtcggtctaccgcgaccggcgcgcgatggaggccgacaactggcacgtcgaactgctcgagcgcctcggcatcggcgtggtgcgcaagaccggcgacgaagtcatgggcatggagccgaccctgctgcccggcgtcgtcggcggcatctaccatcccggcgacgcgcgcctgcgcccggaccgctacgtcgccgaactggcgcggcgcgtgcgcgagctcggcggcgtcatcgaggagggcgcgcgcatcgagggtttcgccaccggcacggccggcatcgacaaggtcgacaccagccgcggcgccttcaccggcgaccgcgtggtgctggcgctgggcgcgtggtcgccgctgctggcgcgcacgctcggcctgcacctgccgatgcagccgggcaagggctattcgatcacctggacgcggccggagctttgcccgcggctgccgctgacgctgagcgaggcctcggtctgcgtgacctcgtgggactccggcttccgcctcggcagcaccatggaattctccggctacgattcgcggctcaaccagcggcgcctgggcgcgctgcggcgcggcgcggcacgctacctgcgccagcccgaggggccggaactgcgcgaggagtggtggggctggcggccgatgagtgtcgacgaggtgccgatcatcggccccagcgcgcgctgggccaacctgatgctcgccaccggccacggcatgatgggcatgagcatgtccgccgccaccggcgaactggtggccgcgctgtgcgccggccccgcgccggcgctggacccgacgccctacgcgccgtcccgcttcggcttgtga

SEQ ID NO: 274 - protein, 418 aa, Unknown
  Obtained from environmental sample
  DOMAIN (7)...(398): FAD dependent oxidoreductase
MNPTHSDALVLGGGVIGLSCALYLLKSGASVRVLEQGTAGCGSSHGNCGTLTPSHAAPLAMPGMIGQALRWMLKRDAPLYVNPKPDLARLRWLLGFARRCNWRDFTRAADARAAILQRSRGLIEELVGSEGLDCEFANGGALSVYRDRRAMEADNWHVELLERLGIGVVRKTGDEVMGMEPTLLPGVVGGIYHPGDARLRPDRYVAELARRVRELGGVIEEGARIEGFATGTAGIDKVDTSRGAFTGDRVVLALGAWSPLLARTLGLHLPMQPGKGYSITWTRPELCPRLPLTLSEASVCVTSWDSGFRLGSTMEFSGYDSRLNQRRLGALRRGAARYLRQPEGPELREEWWGWRPMSVDEVPIIGPSARWANLMLATGHGMMGMSMSAATGELVAALCAGPAPALDPTPYAPSRFGL

SEQ ID NO: 275 - DNA, 1254 bp, Unknown
  Obtained from environmental sample
atgacggaactgaaggccgacgttctcgtgctcggcgccggcatggtcggtgtcggtgccgcactgcacctgcaacgacgcgggcgcgacgtcatcctggtcgaccggaacgagcttgcgggcgaggggacgagctacggcaatgccggcatcatcgaatgcgcctcggtcttcccctacatgtttccccgcgatgtcggggatattctttattatgcgaccaatcgcgcgccgcaggtgcgctaccgcctcgccgatctgccgtccttcctgccgttcttggtgcgctattatctcgcctccgagccgtcacgggcgttgcgcggtgcgatgggcgtgctgccgctgatccggcagagcctcgtcgagcacgaggagctgatcgcggaagccggcgtgccggagctgttgcgaagggacggctggatcaagctgttccgctctgcgaaaaccatggacaaggcgctcggcgagttcgagcgggcgaagcagtatggcgtcgcgggcgatgtcctcgatcccggagcgatcgccgcgcgcgagccgcatctgaccggcgatttcaccggcggcatccatttcacccagccgggcttcgtgcccgatcccggcggcctcgcgaaagcctatgcggcgctgttcacgcgcaagggcgggcgcttcctcgtcgcggacgcgaccacgctcgaacaggcgggtggcggctggcgcgtcagcggggcaggcggcagcgcagtggcgcgcgaagcggtcatcgcgctcggtccatggtccgatctggtgttcggcaagttcggctattccctgccgtttgcggtcaagcgcggctaccatctgcatcttgcgccgcgcggcaacgccgtgctgcagcatccggtcctcgacgccgaccagggttttgtgctggcgccgatgacccgcggcgtccgcgtcaccaccggcgtcgagttcgcccgccgcgacgcgccggagaatttcgcgcaagtcgaggccgcactgccgaaggcgcacaagctgtttccgctgggtgaggccgtcgatgcgaagccgtggcggggcgcgcggccgtgtttgcccgacatgctggctgtgatcggcaaggcgccgcggcatgcgggcctgtggttcgacttcggccaccagcatcacgggctgacgctcggccccgtcaccgggcggctgctggcggagatgatgaccggcgagacgccgttcgccgatcccgcgccgttttcgccgcagcggttcggttga

SEQ ID NO: 276 - protein, 417 aa, Unknown
  Obtained from environmental sample
  DOMAIN (7)...(398): FAD dependent oxidoreductase
MTELKADVLVLGAGMVGVGAALHLQRRGRDVILVDRNELAGEGTSYGNAGIIECASVFPYMFPRDVGDILYYATNRAPQVRYRLADLPSFLPFLVRYYLASEPSRALRGAMGVLPLIRQSLVEHEELIAEAGVPELLRRDGWIKLFRSAKTMDKALGEFERAKQYGVAGDVLDPGAIAAREPHLTGDFTGGIHFTQPGFVPDPGGLAKAYAALFTRKGGRFLVADATTLEQAGGGWRVSGAGGSAVAREAVIALGPWSDLVFGKFGYSLPFAVKRGYHLHLAPRGNAVLQHPVLDADQGFVLAPMTRGVRVTTGVEFARRDAPENFAQVEAALPKAHKLFPLGEAVDAKPWRGARPCLPDMLAVIGKAPRHAGLWFDFGHQHHGLTLGPVTGRLLAEMMTGETPFADPAPFSPQRFG

SEQ ID NO: 277 - DNA, 1254 bp, Unknown
  Obtained from environmental sample
atggcggaactgaaggccgaaattctcgtgctcggcgccggcatggtcggcgtcggtgccgcactgcacctgcagcggcgtgggcgcgacgtcatcctggtcgacaggaacgaagatgccggcgaggggacgagctacggcaatgccggcatcatcgaatgcgcctcagtcttcccctacatgtttccccgcgatatcggggatattctttattatgcgaccaaccgcgccccgcaggtgcgctatcgcctcgccgacctgccgtcgttcctgccgttcctggtgcgctattatctcgcctccgagccgtcacgggccttgcgcggcgcgatgggcgtgctgccgctgatccggcagagtcttgtcgagcacgaggcgctgatcgcagaagccggcgcgggcgagctgctccgcaaggacggctggatcaagctgttccgctctgcgaaaaccatggacaaggcgctcggcgagttcgagcgggccaagcagtatggcgtcgtcggcgatgtcatcgatcccgctgccatcgccgcgcgcgagccgcatctgaccggcgatttcaccggcggcatccatttcacgcagccgggattcgtgaccgatcccggcggattggcgaaggcctatgcggcgtcgttcaggcgcaagggcggacgtttcctcgtcgcggacgcgaccacgctcgaacaggcgggcggcggctggcgcgtcagcggagcgggcgacagcgcagtcgcgcgcgaagccgtgatcgcgctcggcccgtggtccgatctggtattcgctaggctcggctataagctgccgttctcggtcaagcgcggctaccatctgcatctcgcggcacgcggcaacgccgtgctgcagcatcccgtgctggacgccgaccagggctttgtgctggcgccgatgaaccgcggcattcgtctgaccaccggtgtcgagttcgcccgccgcgacgcgccggagaattttgcgcaggtcgaggccgcgctgccgaaggcgcacaagctgtttccgctgggagagcccgtcgacgcaaaaccgtggaggggcgcgcggccgtgcctgcccgacatgctgccggtcatcggcaaggcgcagcgccatccggggttatggttcgacttcggccatcagcatcacggcctgacgctcggcccggtgaccgggcgattgctggcggagatgatgacgggcgaggtgccgttcgccgaccccgcgccgttttcgccgcagcggtttggttga

SEQ ID NO: 278 - protein, 417 aa, Unknown
  Obtained from environmental sample
  DOMAIN (7)...(398): FAD dependent oxidoreductase
MAELKAEILVLGAGMVGVGAALHLQRRGRDVILVDRNEDAGEGTSYGNAGIIECASVFPYMFPRDIGDILYYATNRAPQVRYRLADLPSFLPFLVRYYLASEPSRALRGAMGVLPLIRQSLVEHEALIAEAGAGELLRKDGWIKLFRSAKTMDKALGEFERAKQYGVVGDVIDPAAIAAREPHLTGDFTGGIHFTQPGFVTDPGGLAKAYAASFRRKGGRFLVADATTLEQAGGGWRVSGAGDSAVAREAVIALGPWSDLVFARLGYKLPFSVKRGYHLHLAARGNAVLQHPVLDADQGFVLAPMNRGIRLTTGVEFARRDAPENFAQVEAALPKAHKLFPLGEPVDAKPWRGARPCLPDMLPVIGKAQRHPGLWFDFGHQHHGLTLGPVTGRLLAEMMTGEVPFADPAPFSPQRFG

SEQ ID NO: 279 - DNA, 1251 bp, Unknown
  Obtained from environmental sample
gtgggtgtggcacgtactgatgcaatggttcttggtgccggcattgtcggcacatcggtggcgctgcatctcgcaaaacgcggactcagtgttgccttggtcgatcgcgcggggatcggcgaacagacatcctatggcaacgccggcatcatcgaaggcaacacggtatttcctccggcgtttccttcgcattttgacgcgctcctgcgcgtcgcgcttaagcgtgccagcgaggccaactatcatttgtcattcttgccgcacgtcctgccatggttattggcgttccgcgcggcctcgcgaccggatcgccttgtggagacagcccggctgatccgccctttgttttctcatgcggttgccgagcacgaggcgctgatggccgagagcagcgccacccactacctgcgcaaaaccggctggctcaaagtttatcgtaacgagagcagttttaaggggctggcggctgagttcgacctcgcggcgaaatttggcttgccgctgaatgcactcgacactgtgggagcgcaggcgctcgagccgtcactcaattcggtatttgccaaagcggtgttctggccagaggcggcgagcatcagcagtcccctcggcgtgaccagagcctatgcgtcgcgctttgccgcgctgggaggcgtgctggtggcgggcgacgcgcgatcgctccaccggacgggtaatcgctggcgggtggacaccgcggaaggtgcgcttgatgcccaggagtgcgtggtcgcactcgggccttgggcaacggacttgcttgatgcgctcagtgtgcggttgccgctcgcagttaagcgtggctaccaccggcactttcggtcccaggggaatgcgagcctgtcgcggccggtgctcgacgccgacgtcggctatctgattaccccgatggagcaagggatgcgcataaccaccggtgcggagttcgcgccgcgcgatgcggctcccactccggtgcagtttcttcgcatcatgccgcgggcgcgtgagctttaccctttgggagagcaggtcgacgggcgaacatggttaggcagtcggccgtgctttcccgattctcggcccgtcatcgatcgggcgcccggacatgccgggctgtggctggccatcggtcacgcgcactgggggctcacactgggccccgccaccggacgcatgattgcgcagatgatggccggtgagttgccgttttgcgatcccgcgccttaccgcgcggagcgatttaactag

SEQ ID NO: 280 - protein, 416 aa, Unknown
  Obtained from environmental sample
  DOMAIN (7)...(397): FAD dependent oxidoreductase
  SITE (149)...(152): N-glycosylation site. Prosite id = PS00001
  SITE (289)...(292): N-glycosylation site. Prosite id = PS00001
MGVARTDAMVLGAGIVGTSVALHLAKRGLSVALVDRAGIGEQTSYGNAGIIEGNTVFPPAFPSHFDALLRVALKRASEANYHLSFLPHVLPWLLAFRAASRPDRLVETARLIRPLFSHAVAEHEALMAESSATHYLRKTGWLKVYRNESSFKGLAAEFDLAAKFGLPLNALDTVGAQALEPSLNSVFAKAVFWPEAASISSPLGVTRAYASRFAALGGVLVAGDARSLHRTGNRWRVDTAEGALDAQECVVALGPWATDLLDALSVRLPLAVKRGYHRHFRSQGNASLSRPVLDADVGYLITPMEQGMRITTGAEFAPRDAAPTPVQFLRIMPRARELYPLGEQVDGRTWLGSRPCFPDSRPVIDRAPGHAGLWLAIGHAHWGLTLGPATGRMIAQMMAGELPFCDPAPYRAERFN

SEQ ID NO: 281 - DNA, 1242 bp, Unknown
  Obtained from environmental sample
atgaaattcgacatcatcgttgccggcgcaggcgtcatcggcgtgtgcgttgcggtccatctgcagaagcggggccgttccgtgctgctggtggaccggcgcgagcccggtttcgagacctcgttcggcaatgccgggttgatccagcgcgagggcgtctatccgtatggatttccgcgcggcgtgagcgtgctcctgcgccatgggctcaaccgcggggtcgacgtgcacatccacccgctggcgctgccgcggatcgcgctgttcctgtggaaatactggcgccattcgcggcccgcccgacaccgggagatcgcgcgcgcttatgccaagctcatcgagcgttgcgtcgacgagcacgacgcgctggtggccgaggccggggcggagcacctgatccgccgcgacggctggctgaagctgttccgcaccgaacaggagcgcgatctgcgcttcgccgaagccgagcgttggcgtggcgagttcggcgtgcagtatcggatgctcgaccgcgccgacgtggcgcgcgaggagccgttcctcgcggcggggctcgtcggcgcgctgcactggacgcagccgacccgcacgcccgaccccaacggcctggtctcggcctatgcggcgctgttcaagtcgctcggcggggttttcctgcagggcgatgccaggacgctcgcggccaacggcagcggctggagcctcacgaccaacaagggtccggcacaggccgcaggcgcagtgatcgcgctcgggccgtgggcggacacggtgacgctcgggctcggctacagtctgccgctcgcggtgaagcgtggctatcacatgcattaccgcgccgccggcgaggcgaagctcaatcatccggtgctcgaccacgagcgcggctatctcatcgcaccgatggcgcgcggcatccgcctgacgaccggcgccgagttcgccatgcgcgattccgtgcgcacgccggtgcaactcgatcgggcggagccgattgcccgcgacctgttccccctggccgagcggtttgatgcgcagccgtggatgggagcgcgaccgtgcacgcccgacatgatgccgatcatcggccccgctccgaaacatcggaacctgtggttcgccttcggccatgcccaccacggcctgacgctgggcgccgtcaccggccgcctggtcgccgagatggtcaccggcgaagcgcccgtggtcgacccgagcccttatcgcgccgaccgattctga

SEQ ID NO: 282 - protein, 413 aa, Unknown
  Obtained from environmental sample
  DOMAIN (4)...(395): FAD dependent oxidoreductase
  SITE (232)...(235): N-glycosylation site. Prosite id = PS00001
MKFDIIVAGAGVIGVCVAVHLQKRGRSVLLVDRREPGFETSFGNAGLIQREGVYPYGFPRGVSVLLRHGLNRGVDVHIHPLALPRIALFLWKYWRHSRPARHREIARAYAKLIERCVDEHDALVAEAGAEHLIRRDGWLKLFRTEQERDLRFAEAERWRGEFGVQYRMLDRADVAREEPFLAAGLVGALHWTQPTRTPDPNGLVSAYAALFKSLGGVFLQGDARTLAANGSGWSLTTNKGPAQAAGAVIALGPWADTVTLGLGYSLPLAVKRGYHMHYRAAGEAKLNHPVLDHERGYLIAPMARGIRLTTGAEFAMRDSVRTPVQLDRAEPIARDLFPLAERFDAQPWMGARPCTPDMMPIIGPAPKHRNLWFAFGHAHHGLTLGAVTGRLVAEMVTGEAPVVDPSPYRADRF

SEQ ID NO: 283 - DNA, 1263 bp, Unknown
  Obtained from environmental sample
atgaaagccatcgttctgggcagcggcgtgctgggcaccaccaccgcctattacctggccaagcagggccatgaggtcgtggtgatcgaccgccaggaaggtccggcgctggagaccagcttcgccaatgccggcgaggtctcgcccggctattcggccccctgggcggctcccggcgtgccggtcaaggcggtgaagtggatgttcatgaagcatgcgccgctgatcctgcgcccccatatggacccgttccagtggcgctggatggccaagatgctgctgaactgcaattccaagagctatgccgtcaataagggccgcatggtgcgtctggcggaatattcccgcgatatgctgcgcgatctgcgcgccgatatcggcatttcctatgacgagcgcaccaaaggaacgctacagctgttccgcaagcagcagcaggtcgatgcctcggctgccgatatggcggtgctggaccagtatggcgtgccttacgaagcgctggatgtcgaaggctgcgtgcgctatgagccgggcctgcgctattcgcaggacaagatcgtcggcggcctgctgctgcccggcgacgagaccggcgactgcttcaagttcaccaatgccctggccgagaaggccaaggaactgggcgtgcagttccgcttcggcaccactatcaacagcatcatccgcaccggcagcaaggtgaccggcgtgcagaccagcgccggcgaattctccggggatgccgtggtggtggcgctgggcagctattcccgcttcctgctggagccgctgggcttcaccgtgccggtctatccggtcaagggctattccatcaccttgccgatcacccaggaagacgccgctccggtctcgaccgttctggacgaaacccacaaggtcgccatcacccgtctgggcgaccgcatccgcgtggctggcatggccgagctgaacggctataatatggacctgccgcagagccgccgcgataccgtcgaatatgtggtttcggacctgtatcccaagggcggcgatgtctcgaagtcggaattctggtgcggcctgcgcccgatgacccccgacggcactccgatcctgggccccacggcctatcagggcctgtatctgaacaccggccatggtaccctgggctggaccatggcctgcggttcgggccgcgtgctggccgatgtcatctcgggtcgcaaaaccgatatcgacatgggcggtttgaccctggatcgctacggcaacgccgcttaa

SEQ ID NO: 284 - protein, 420 aa, Unknown
  Obtained from environmental sample
  SIGNAL (1)...(20)
  DOMAIN (2)...(398): FAD dependent oxidoreductase
MKAIVLGSGVLGTTTAYYLAKQGHEVVVIDRQEGPALETSFANAGEVSPGYSAPWAAPGVPVKAVKWMFMKHAPLILRPHMDPFQWRWMAKMLLNCNSKSYAVNKGRMVRLAEYSRDMLRDLRADIGISYDERTKGTLQLFRKQQQVDASAADMAVLDQYGVPYEALDVEGCVRYEPGLRYSQDKIVGGLLLPGDETGDCFKFTNALAEKAKELGVQFRFGTTINSIIRTGSKVTGVQTSAGEFSGDAVVVALGSYSRFLLEPLGFTVPVYPVKGYSITLPITQEDAAPVSTVLDETHKVAITRLGDRIRVAGMAELNGYNMDLPQSRRDTVEYVVSDLYPKGGDVSKSEFWCGLRPMTPDGTPILGPTAYQGLYLNTGHGTLGWTMACGSGRVLADVISGRKTDIDMGGLTLDRYGNAA

SEQ ID NO: 285 - DNA, 1263 bp, Unknown
  Obtained from environmental sample
atggccagacctcgttcagtcatcatttgcggcggcggcatcatcggcctctgcaccgcgtattcactcgcccgcgagggtttccgcgtgaccctgctcgagcgcaacgccgagggtgctgactcctgcgcgcacggcagcgccggctacgtgtcgccgagccacgtcgcgccgatctccgcgccgggcatggtgctgaagggcctgaaatggatgatgagctcgcgcagcccgttctacatcaagccgcggctcgacacggagctcatgcgctggggatggctgttcgcccgcgcgtgcacggcgaaacacatgcgacgctccgcgcccgtgctgcgcgacctctgcctcggcggtcgcgagctgttcgtcgagctggcggatatcacgggcaacagtttcgaactgaagaccgagggattgctgaatctctgcaagacgcccgaaggtctcgaccacgaggcacacggactcgccgtgctggccaacgaggtgggcgtggaggcgcgcgtgctcgatgggaagcagaccgcggcacttgagccgggcatcaagatggaggtggccgggtcggtctattttccgattgatgcgcacctgacgccgcggaagttcatgccggcactcgtggcgctgctgaaggaaatgggcgtgaagttccattggaacacgagcgtctacggttggcgttccgaagcggggcgcatcgccggcgtccagacgaccgcgggcgacctggtggccgacgactatgtgctcgccggtggttcgtggtcgccgtcgatggtggccgggttgagcatccgcatcccgatgcaggcgggcaagggctacagcctgacgatcgagaaaccccgcttccgtctgaccaagtcgcttatcctgaccgaacgccgggtggcggtgacaccgatgggcgaccagttgcgttttggtggcaccatggaaatcgccggccacagcgacaacgtgcgccaggagcgcatcgaacagatcattgccgcggcgccgcactatttccccgagttcacgccgcgggacttcgcgggcatcaagccgtggttcggttaccggccggtcacgcccgatggcttgccgtacattggacgtttccgccgccaccagaacctcgtcgcggcgtgcggccacgcgatgcttggcgtcacgatggcgccgattaccggccgtctcgtgggcgaggtgctcacgggcaggaaaccgagcgtggacctgagcctgttgaatccggacaggtacgcgtag

SEQ ID NO: 286 - protein, 420 aa, Unknown
  Obtained from environmental sample
  SIGNAL (1)...(24)
  DOMAIN (6)...(401): FAD dependent oxidoreductase
  SITE (226)...(229): N-glycosylation site. Prosite id = PS00001
MARPRSVIICGGGIIGLCTAYSLAREGFRVTLLERNAEGADSCAHGSAGYVSPSHVAPISAPGMVLKGLKWMMSSRSPFYIKPRLDTELMRWGWLFARACTAKHMRRSAPVLRDLCLGGRELFVELADITGNSFELKTEGLLNLCKTPEGLDHEAHGLAVLANEVGVEARVLDGKQTAALEPGIKMEVAGSVYFPIDAHLTPRKFMPALVALLKEMGVKFHWNTSVYGWRSEAGRIAGVQTTAGDLVADDYVLAGGSWSPSMVAGLSIRIPMQAGKGYSLTIEKPRFRLTKSLILTERRVAVTPMGDQLRFGGTMEIAGHSDNVRQERIEQIIAAAPHYFPEFTPRDFAGIKPWFGYRPVTPDGLPYIGRFRRHQNLVAACGHAMLGVTMAPITGRLVGEVLTGRKPSVDLSLLNPDRYA

SEQ ID NO: 287 - DNA, 1257 bp, Unknown
  Obtained from environmental sample
atgagccaaggaagcgtggtcattattggtgccggaataatcggtgcctggtccgcgtattttctcagtcgatcaggctggcaggtgacgatactggatcaaggcggcttcggaaaaggctgttcgcatggcaattgcggttatgtttcgcccagccatgtgctacccattcctggaccgaagaccatccgcacagccatccgggcactgctccaaccgaacggaccattcaagatccgcttccgcttcgatcctgccttatggagctggatgtatcgctttctgcgtcgctgcaactaccacgacatgattcaggcgggccatgccctgaacccgctcttacaatcctcacgcgagttgttcgagcagataatccgggacgagaaactggactgcgaatggcaggcccgtgggttgatcctcgtttttcgcacgacgaaaggcatggaggaatatgcggaaaccgacaagctgctgagcgatacgtacggcgtgccggcaaagcggcttgacgaggacgaattgacagcgtttgagccggccctcaaacccggactgggcggtggctggttgtacgacatggatgcacacctcaggcctgaccgcttcatggccgaaatgcggcgcgtcctctctgaacgaggggtgaccattctcgaagggaagactttccgtgagttccgtcgggctggccgacaggccgaggcggcggtcacggaccacggcgaactgcgagccgatgcgtttgtcattgccaccggggcttggacgccgcgattccgcaatcaacttggttgtgtcataccgattgaaccgggcaagggctattcaatcacgatgggcaaacccagccgctgtccccaagtgcccctcatcttcgaggaacaccgcgtggctgtcacgcccatggtcagcgcgtacaggctcggttccacaatggaatttgccggttacgacgcgacattgcggcgtgatcgcttggaccttctcaagctcggggccgcaacgtacctccaggagcctgtcggcgagccgattaccgaagagtggttcggctggcgtccgatgacgccggacggcgtgccgatgattggcccgtcacctcggctcggaaacgtgttgatcgcagctgggcacaatatgatcggcctggccactggctccggcaccggccggctcgttgcagaactgcttaccgggcaacctccacacctcgatccccaaccctataatcccgcacgcttcgggacgctttga

SEQ ID NO: 288 - protein, 418 aa, Unknown
  Obtained from environmental sample
  DOMAIN (5)...(397): FAD dependent oxidoreductase
MSQGSVVIIGAGIIGAWSAYFLSRSGWQVTILDQGGFGKGCSHGNCGYVSPSHVLPIPGPKTIRTAIRALLQPNGPFKIRFRFDPALWSWMYRFLRRCNYHDMIQAGHALNPLLQSSRELFEQIIRDEKLDCEWQARGLILVFRTTKGMEEYAETDKLLSDTYGVPAKRLDEDELTAFEPALKPGLGGGWLYDMDAHLRPDRFMAEMRRVLSERGVTILEGKTFREFRRAGRQAEAAVTDHGELRADAFVIATGAWTPRFRNQLGCVIPIEPGKGYSITMGKPSRCPQVPLIFEEHRVAVTPMVSAYRLGSTMEFAGYDATLRRDRLDLLKLGAATYLQEPVGEPITEEWFGWRPMTPDGVPMIGPSPRLGNVLIAAGHNMIGLATGSGTGRLVAELLTGQPPHLDPQPYNPARFGTL

SEQ ID NO: 289 - DNA, 1284 bp, Unknown
  Obtained from environmental sample
atggcgaccgaaacggagcaatcagcggaatccatgccagacacagacatccttgtactcggcgccggcattgtcggcacctccgtcgcgctgcatctcgctcagcgaggcctgaaggtaaccctggttgatcggcaggggccggggaaggggacctcgtacggcaatgccgggatcatcgaaggcaacacggtgttcccgccggcatttccgtcggatttcggcacgctgctgaaggtcgtgttcaggcgctcgacgatcgccagctatcatctctccttcctgccgcaggtcgcgccctggctgatggcattccgcgcggcgtcgcagcccaagcagctggtcgagaccgcgcatctgatgcggccgctgtttgcccgcgccgtggccgagcacgaggagttggtgctggcctcgggcgccgggcggcacttgcgcaagaccggctggttgaagctctaccgcagcgacgcctcgatcgcagcgctcaagccggaattcgatctcgctgcgtcgttcgggctttcactcagtccgctcgacatccagggcgcgttggagctggagccgtcgctcgcgccggtgttccgccatgccgtgttctggccaggcgccgccagcatcgacaatccgctggccttgaccgaggcctatgcggcgcgctttgccgcgctcggcggcgtgaccgtcaaaggcgaagcacgctcgctgcgccgggaaggacacatttggcgggtcgaaaccgccgatggtccggccgttgcggagcaggcggtggcggcgctcggcccctgggcgcctgacgtattggagcctctcggcatcaggctgccgctcggcgtaaagcgcggctatcaccgccacttcagggcgcagggcaatgcggctttgacgcgtccggtgctcgacgccgatgtcggctattgcctggcgccgatgcagcaggggatccggcttaccaccggcgccgaattcgccgcgcgcgacgcgccgccgacgccggcgcagctcgcttcggtgctcccctatgcgaaagcgctgtttccgctcggcgagtcagtcgaggcgcagccgtggatggggtcacgcccctgcttcccggattcgcgtccggtgatcggcaaggctgcgggccagccgggactgtggctcgccatcggccacgcgcattgggggctgacgctcggccccgtcaccggccggctgatcgccgaaatggtcaccggcgcgacgccgttctgcgatcccgccccgtatcgcgcggagcggttcctcgggtcctaa

SEQ ID NO: 290 - protein, 427 aa, Unknown
  Obtained from environmental sample
  DOMAIN (16)...(406): FAD dependent oxidoreductase
MATETEQSAESMPDTDILVLGAGIVGTSVALHLAQRGLKVTLVDRQGPGKGTSYGNAGIIEGNTVFPPAFPSDFGTLLKVVFRRSTIASYHLSFLPQVAPWLMAFRAASQPKQLVETAHLMRPLFARAVAEHEELVLASGAGRHLRKTGWLKLYRSDASIAALKPEFDLAASFGLSLSPLDIQGALELEPSLAPVFRHAVFWPGAASIDNPLALTEAYAARFAALGGVTVKGEARSLRREGHIWRVETADGPAVAEQAVAALGPWAPDVLEPLGIRLPLGVKRGYHRHFRAQGNAALTRPVLDADVGYCLAPMQQGIRLTTGAEFAARDAPPTPAQLASVLPYAKALFPLGESVEAQPWMGSRPCFPDSRPVIGKAAGQPGLWLAIGHAHWGLTLGPVTGRLIAEMVTGATPFCDPAPYRAERFLGS

SEQ ID NO: 291 - DNA, 1263 bp, Unknown
  Obtained from environmental sample
gtgagccatgttgcggtcatcggcggtggcgtggtcggcgtcgcgtgcgcgtactatctatcgcgcggcggctggcaggtcacgctcgtcgatcggggccgcatcgggggcggctgctcgcatgccaattgcgggttcgtttcgcctagccatgtgctgccgttggccgagccgggagcgatccgccgcgtcctgcgtgcgatgctgaagaaggactccccgttctacatcaagccgcgccccgatccggcgctgtggggatggctgatgcgcttcgcgcggcgctgcaacatgaccgatatgcttgccggggggcgcgcctgtcatgcgctgctcgaatcgtcgcgcgtgctgtacccggcgctccttagcgaggagcaaatcgattgcgagtgggagccgcgggggctgttgttcgtctgccagacgcggccggcgctggatcactttgccgccaccgatgcgctgttggccaggcatttcaatctgccggcgcggcggatcgatggcgaagagctcgccgagttcgagccggcgcttttgccggggatggccggcggatacttttacgaagaggactcgcatttgcgccccgaccgattgatggcggagtggcggcgcgtattggagcggcgcggcgttcgcgtgatcgagaactgtgaatttcgcggctttgtggcgcacgatggcgccaccgcctcgaacggcgccgctcgtcgggcgaaaacgtcgctcgatgaaatccaggccgacgcgttcgtggtcgccaccggcgcctggacgccgcttttggcaagtgaaatcggctgccgagtgccgatccagcccggcaagggttactcgatgaccatgccgcgaccggccgtctgcccgcgagtgccgatgatcctggtcgagcatcgcgtggcggtcactccgatgcgctcgggctaccggcttggttcgacgatggagtttgcgggctacgacacgtcgctgcggccagcgcggctggagctgttgcggcgtggcgccgccgcctgcctgcgcgagccgtactgtgaaccggtgcaggaaacttggtacggctggcggcccatgacctacgacagcgtgcccgtgatcgaccgcagtccgaaatggcacaacgtgtttatcgccgcgggccacaacatgcttggactgtcgatggcgacgggcaccggcaagctcgtggcggaattggtcagcggtcgcgagccgcatattgacccggcggcttatagcatggggcggttcgggtga

SEQ ID NO: 292 - protein, 420 aa, Unknown
  Obtained from environmental sample
  DOMAIN (3)...(401): FAD dependent oxidoreductase
  SITE (98)...(101): N-glycosylation site. Prosite id = PS00001
MSHVAVIGGGVVGVACAYYLSRGGWQVTLVDRGRIGGGCSHANCGFVSPSHVLPLAEPGAIRRVLRAMLKKDSPFYIKPRPDPALWGWLMRFARRCNMTDMLAGGRACHALLESSRVLYPALLSEEQIDCEWEPRGLLFVCQTRPALDHFAATDALLARHFNLPARRIDGEELAEFEPALLPGMAGGYFYEEDSHLRPDRLMAEWRRVLERRGVRVIENCEFRGFVAHDGATASNGAARRAKTSLDEIQADAFVVATGAWTPLLASEIGCRVPIQPGKGYSMTMPRPAVCPRVPMILVEHRVAVTPMRSGYRLGSTMEFAGYDTSLRPARLELLRRGAAACLREPYCEPVQETWYGWRPMTYDSVPVIDRSPKWHNVFIAAGHNMLGLSMATGTGKLVAELVSGREPHIDPAAYSMGRFG

SEQ ID NO: 293 - DNA, 1245 bp, Unknown
  Obtained from environmental sample
atgcattgccagaccatcgtcctgggcgccggcatcgtcggcgtcagcaccgccctgcacctgcaggcccgcgggcgccaggtgatcctcgtcgaccgcgacgaaccgggcagcggcaccagccatggcaacgccgggctgatcgagcgctccagcgtgatcccctacgccttcccgcgccagtggagtgccttgctgcgctacggcctgaaccgccagcccgacgtgcgctacagcctgacccacctgcccaaggccgcgccctggctgctcagctattggcgccagtccgcccccgggcaactggccaaggccgccgccgacatgctgccgctggtgcaacgcagcgtcgaggaacacgatgtgctgatcgaagccgccggcctgcaaggactggtacaggccaagggctggatcgaggtgtaccgtgatgccgcgctgttcgaacaggccaagcgcgacctgaaggggctggcccgctacggcctgcagtacgaaatcctcgaacgcgaacagttgcaggcccgcgaacagcaactggacggtggcgtgatcggcggcatccactggctcgacccgaagacggtgagcaacccgggcggcctgacccgtggctacgccgcgctgttcgtccagcgtggtgggcagttcctccatggcgacgcgcgcagcctgcgccaggtcgagggcggctggcagctggacacgcgtcgcggcagcgtcaccgccgacgaagtggtggcctgcctcggcccgcagtcggccgacctctacgagcggctgggctaccgctttccgctgggcatcaagcgcggctaccacatgcactacgccacccgcgagggtgccgagctgggtcattcgatttgcgacacccagggcggttacgtcctggcgccgatggcccgtggtgtgcgcctgaccaccggcatcgagttcgcggcgagcgacgccgccgccaacgagatccagctacgccgctgcgaggcactggcacgccagctgttcccggccctgggcgagcgcctggacgacaagccctggctgggccgccgtccctgcctgccagacatgcgcccggtgatcggcccggcgcccctgcacaagcacctgtggttcaacttcggccatgcccaccacggcctgaccctgggcccggtcagcggccgcctgctggcggagctgatgaccggcgagcgccccttcaccgaccctgcgccctacagcgccgcacgtttcgactga

SEQ ID NO: 294 - protein, 414 aa, Unknown
  Obtained from environmental sample
  DOMAIN (4)...(395): FAD dependent oxidoreductase
MHCQTIVLGAGIVGVSTALHLQARGRQVILVDRDEPGSGTSHGNAGLIERSSVIPYAFPRQWSALLRYGLNRQPDVRYSLTHLPKAAPWLLSYWRQSAPGQLAKAAADMLPLVQRSVEEHDVLIEAAGLQGLVQAKGWIEVYRDAALFEQAKRDLKGLARYGLQYEILEREQLQAREQQLDGGVIGGIHWLDPKTVSNPGGLTRGYAALFVQRGGQFLHGDARSLRQVEGGWQLDTRRGSVTADEVVACLGPQSADLYERLGYRFPLGIKRGYHMHYATREGAELGHSICDTQGGYVLAPMARGVRLTTGIEFAASDAAANEIQLRRCEALARQLFPALGERLDDKPWLGRRPCLPDMRPVIGPAPLHKHLWFNFGHAHHGLTLGPVSGRLLAELMTGERPFTDPAPYSAARFD

SEQ ID NO: 295 - DNA, 1296 bp, Unknown
  Obtained from environmental sample
atgcacatcattgtcatcggcggcggcgtcatcggcctgagcgccgcctggtttttgcgagaagaaggttgtgaggtaacggtgttggaaaaaggcgacctcacagacaactgttcttttgggaatatgggctacctgtcgccttcgcacttcgtaaccttagcctcgcccggtgtggtagaacagggcctgctgtggctgctgaatgcggaaagccctttctacattcggcccagcctgagctggtcgttagtggactggggtcttaagttcatgcgcgcttctacgcgggcacacgtggagcgttctgcacggccactggccgacttgctgctgctgtcaaaagcagagacgaaacggtggatagacgccggcctgcttcaggtagagtacaccgagcgcggttgcattatgtactacaacactcctaagggcgaacgcggtgaaatagaaacggctcgaaaggctgaagaactgggcttgaaggtaacagtgctcgaccgcgaccaagcgcgcactttggagcctgacgcccagctcgaagtacgcggaggagtgctgtaccacgacgatgcacacctttatcctaatgcactcatggagcagctgccgcgcttgttggaaagccgaggtgttcgcattcagcgaaatgcggaagtagtggcctttgagcgcgttaacggcgcaattgctgccgtgcgctgctgctccacaaccgaaacaggccgtgaaaacccagaacatctggaggccgacgcggtagtcctggcagcaggctcctggtcgccactgctggcacgcctgtgtggcgaatacttgccgctgatgcctggcaaaggctactccattacggtggacaatccagagcgcactctccatcacccttgcatcctcaaggaagctaaagtggccctgacgccctggagccatcggctccgcatcggcagcaccatggaaataggtcacatggatggccgcatccgattgcggcgcgtgcagggcatcttacgggcagtgcgccaatacatgcctggcattgccaatgacccaggagtccgtgcccttgaggacgcaactactttgcaacggcgcacgtggtttggctatcgccccctatcggctgatggcatgccctacattggctttgcccgaaaaaatcgcaatctaattatcgccacggggcattccatgttgggcgtgagcttggctgctggaacgggcaagctcgtagcagagttggtctgcgggaaaccaacatctctgcctgtagagcctttcgacccgaagcgcttttga

SEQ ID NO: 296 - protein, 431 aa, Unknown
  Obtained from environmental sample
  DOMAIN (2)...(413): FAD dependent oxidoreductase
  SITE (37)...(40): N-glycosylation site. Prosite id = PS00001
MHIIVIGGGVIGLSAAWFLREEGCEVTVLEKGDLTDNCSFGNMGYLSPSHFVTLASPGVVEQGLLWLLNAESPFYIRPSLSWSLVDWGLKFMRASTRAHVERSARPLADLLLLSKAETKRWIDAGLLQVEYTERGCIMYYNTPKGERGEIETARKAEELGLKVTVLDRDQARTLEPDAQLEVRGGVLYHDDAHLYPNALMEQLPRLLESRGVRIQRNAEVVAFERVNGAIAAVRCCSTTETGRENPEHLEADAVVLAAGSWSPLLARLCGEYLPLMPGKGYSITVDNPERTLHHPCILKEAKVALTPWSHRLRIGSTMEIGHMDGRIRLRRVQGILRAVRQYMPGIANDPGVRALEDATTLQRRTWFGYRPLSADGMPYIGFARKNRNLIIATGHSMLGVSLAAGTGKLVAELVCGKPTSLPVEPFDPKRF

SEQ ID NO: 297 - DNA, 1242 bp, Unknown
  Obtained from environmental sample
atgcagtctattgcagttatcggcggtggaatcaccggcgtcacttccgcttatgcccttgctaagcgtggttatcaagttaccctttttgaaaagcagcgctatgcagcgatggaaacctcttttgccaatggtggtcagctatcggcctctaatgcagaggtttggacctgctggtcgactattctcaaaggattaaagtggatgctaaaaaacgatgcgccactgctcgtaaatcccaagccatcttggcataagttcagttggtttgctgaatttatcgcttcaatacctcagtatgaaaacaatacgaccgagacggcacgtatggcgattgcagcgcgtgagttattgtttggctgggctaaagaagaaaatatcgatttcgatcatgtcgagaagggaatactgcatatttatcgtgataaagctggttttgaacacgctcaaaaagtctcccaattgcttgctaaaggtggtttggtgcgcgaaacgctttctccaagtgacattcagcgaatcgagcctacgctaaaagggagttactacggtggctttttaacacccagtgataccaccggtgatatccataaatacacccaaggtttagccagagcctgtgagcgtttgggtgttaactgtctgtatgagcaagaagtgttggaagttaaggctgatgatcgtgaagctagggtaattgttaagtcagtagaaggctcgattagccatcaattcgatgcgcttgtggtatccgctggtgtggccagtcggaaactagcggcgtcacttggcgatagagtcaatatctatccggtgaagggttattccattacggtcaatttgttagatgagcaaagccaagcagctgcgcctatggtgagtttattggatgatgagactaaattagtgaccagtcgcttaggaaaagatcgtttccgcgtggcgggtactgcagagtttaacggctacaacaaagatatcagggctgatcgtattaagcctttggtggactgggtgaatcaatgcttcccagatgtaaacacacgaagcgtagttccttgggcgggacttcgtcctatgatgcctaatatgatgccaaaagtgggtaagggtaaattacccaccgtattctacaataccggtcatggccatttgggttggacgttaagtgcggtgacggctgatatgttagcggatgtgatcgatcaggctagcacctcggcacaatttgttcccgcttga

SEQ ID NO: 298 - protein, 413 aa, Unknown
  Obtained from environmental sample
  SIGNAL (1)...(21)
  DOMAIN (3)...(400): FAD dependent oxidoreductase
  SITE (103)...(106): N-glycosylation site. Prosite id = PS00001
MQSIAVIGGGITGVTSAYALAKRGYQVTLFEKQRYAAMETSFANGGQLSASNAEVWTCWSTILKGLKWMLKNDAPLLVNPKPSWHKFSWFAEFIASIPQYENNTTETARMAIAARELLFGWAKEENIDFDHVEKGILHIYRDKAGFEHAQKVSQLLAKGGLVRETLSPSDIQRIEPTLKGSYYGGFLTPSDTTGDIHKYTQGLARACERLGVNCLYEQEVLEVKADDREARVIVKSVEGSISHQFDALVVSAGVASRKLAASLGDRVNIYPVKGYSITVNLLDEQSQAAAPMVSLLDDETKLVTSRLGKDRFRVAGTAEFNGYNKDIRADRIKPLVDWVNQCFPDVNTRSVVPWAGLRPMMPNMMPKVGKGKLPTVFYNTGHGHLGWTLSAVTADMLADVIDQASTSAQFVPA

SEQ ID NO: 299 - DNA, 1242 bp, Unknown
  Obtained from environmental sample
atgcagtctattgcagtcatcggcggtggaatcaccggcgtcacttccgcttatgcccttgctaagcgtggttatcaagttaccctttttgaaaagcagcgctatgcagcgatggaaacctcttttgccaatggtggtcagctatcggcctctaatgcagaagtttggacctgctggtcgactattcacaaaggattaaagtggatgctaaaaaacgatgcgccgctgctcgtaaatcctaagccatcttggcataagttcagttggtttgctgaatttatcgcttctatacctcagtatgaaaacaatacgaccgagacagcgcgtatggcgattgccgcgcgtgagttattgtttggctgggctaaagaagaaaatatcgatttcgatcatgtcgagaaaggaatattgcatatttatcgtgataaagctggctttgagcatgctcaaaaagtttctcaattgctagctaaaggtggtttggtgcgcgaaacgctttctccaagtgacattcagcgaatcgagcctacgcttaaagggagttactacggtggctttttaacacccagtgatactaccggtgatatccataaatacacccaaggcttagccaaagcctgtgagcgtttgggtgttaactgtctgtatgagcaagaagtgttggaagttaaggctgatgatcgtgaagctagggtaattgttaagtcagtagaaggctcgattagccatcaattcgatgcggttgtggtatccgctggtgtggccagtcggaaactagcggcatcacttggcgatagagtcaatatctatccggtgaagggttattccattacggtcaatttgttagatgagcaaagccaagcagctgcgcctatggtgagtttattggatgatgagactaaattagtgaccagtcgcttaggaaaagatcgtttccgcgtggcgggtaccgcagaatttaacggctacaacaaagatatcagggctgatcgtattaagcctttggtggactgggtgaatcaatgcttcccagatgtaaacacacgaagcgtggttccttgggcaggacttcgtcctatgatgcctaatatgatgccaaaagtgggtaagggtaaattacccaccgtgttctacaataccggtcatggccatttgggttggacgttaagtgcggtgacggctgatatgttagcggatgtgatcgatcaggctagcacctcggcacaatttgttcccgcttga

SEQ ID NO: 300 - protein, 413 aa, Unknown
  Obtained from environmental sample
  SIGNAL (1)...(21)
  DOMAIN (3)...(400): FAD dependent oxidoreductase
  SITE (103)...(106): N-glycosylation site. Prosite id = PS00001
MQSIAVIGGGITGVTSAYALAKRGYQVTLFEKQRYAAMETSFANGGQLSASNAEVWTCWSTIHKGLKWMLKNDAPLLVNPKPSWHKFSWFAEFIASIPQYENNTTETARMAIAARELLFGWAKEENIDFDHVEKGILHIYRDKAGFEHAQKVSQLLAKGGLVRETLSPSDIQRIEPTLKGSYYGGFLTPSDTTGDIHKYTQGLAKACERLGVNCLYEQEVLEVKADDREARVIVKSVEGSISHQFDAVVVSAGVASRKLAASLGDRVNIYPVKGYSITVNLLDEQSQAAAPMVSLLDDETKLVTSRLGKDRFRVAGTAEFNGYNKDIRADRIKPLVDWVNQCFPDVNTRSVVPWAGLRPMMPNMMPKVGKGKLPTVFYNTGHGHLGWTLSAVTADMLADVIDQASTSAQFVPA

SEQ ID NO: 301 - DNA, 1254 bp, Unknown
  Obtained from environmental sample
atgtccaaggttaccctcgtgctcggcgccggcattatcggcgtttccacagccatccatctcgcccgtcgagggcgctcggtggtgctggtggatcgccggggcgccggcgaggaaacctccttcggtaatgccggcctgatccagcgcgagggcgttgtgccctacggcttcccgcaggagctcgggatgctgatccgttatggcttcaacaaccggatcgacgcccattaccatgcaagcgcgatgctgaagctcgtgccgttcctgtcgcgctactggtggcattcgaacaagagccggcatcaggtcatcgcacgcgcctatgcacccttgatcgaaaactcgatcagcgagcatcaggacctgatccaggcggcgaatgccgaccatctgatccgcaaggacggctggatggagatcttccgcacggccggcaaacgcgacacggagctcgccgaggcagaacgactggcgcgtgaatacggtgtcagttaccgggcactcaaccgcgaagaactggccaaggaagagccgcatatccgcggcgatttcgtcgggggcctcaagtggaatgacccgtggtcggtgaccaatccgcatggcctgaccatggcttacctcagctacttccagtcgctcggcggacgcttcgtcaagggcgacgccacgacgctggaaacgggcgcatccggcaagggctggcgcgtgaagacggatgacggcatggtcgatggcgacgatgtggtgctggcactcggcccatggtcggaggaggtcacccgcaaattcggctaccgtttcctgctcggcgtcaagcgcggctaccacatgcattatgcgcccgaagctaatgcggtcctcaacaactggacgatggatgccgagcgcggttacttcctcgcgccgatggaaaagggcatccgcctgacgacgggtgcggaatttgccaagcgcgatgcgccgaagtccccggttcaactggcgcgcgccgaaaaggtggctcgagagatcttcccgctggctgagcggctggatgccgagccctggatgggtgcccgcccctgcacgccggacatgatgccggtcatcggcaaggcaccgcgccatcagggcatgtggttcgccttcggccatgcgcatcatggcctcacactcggcccggtgaccggccgcttgatcgcggaaatgatggacggggaagagacgttcatcgacgccaaggcctggggccctgaacgttttcgcccctga

SEQ ID NO: 302 - protein, 417 aa, Unknown
  Obtained from environmental sample
  DOMAIN (4)...(397): FAD dependent oxidoreductase
  SITE (80)...(90): Zinc carboxypeptidases, zinc-binding region 2 signature. Prosite id = PS00133
  SITE (99)...(102): N-glycosylation site. Prosite id = PS00001
  SITE (294)...(297): N-glycosylation site. Prosite id = PS00001
MSKVTLVLGAGIIGVSTAIHLARRGRSVVLVDRRGAGEETSFGNAGLIQREGVVPYGFPQELGMLIRYGFNNRIDAHYHASAMLKLVPFLSRYWWHSNKSRHQVIARAYAPLIENSISEHQDLIQAANADHLIRKDGWMEIFRTAGKRDTELAEAERLAREYGVSYRALNREELAKEEPHIRGDFVGGLKWNDPWSVTNPHGLTMAYLSYFQSLGGRFVKGDATTLETGASGKGWRVKTDDGMVDGDDVVLALGPWSEEVTRKFGYRFLLGVKRGYHMHYAPEANAVLNNWTMDAERGYFLAPMEKGIRLTTGAEFAKRDAPKSPVQLARAEKVAREIFPLAERLDAEPWMGARPCTPDMMPVIGKAPRHQGMWFAFGHAHHGLTLGPVTGRLIAEMMDGEETFIDAKAWGPERFRP

SEQ ID NO: 303 - DNA, 1269 bp, Unknown
  Obtained from environmental sample
gtgaaagtgctcgtcctgggcgcgggtgtggtgggcacggccacggcgctggcgctggcccggcgcggccttgaggtcaccctcgtcgatcgcgagcccgaacccgcccgagggaccagtcatgccaacggcggcggcatcaccccggcccacgccgagccctggaatgcgccgggcatcggctggaagctgctgcgctggctgggccgccgcgacgcgccgttccggctcaggcccgccgcaatccccggcatggcgggctgggggctctccttcctgtggaactcccggcgccggcgcttcctcgtcaacgcccgtgccagcatccggctggcggtgtattcggccgagtgcctggccgaatggcgcgaagccttcgggctgcagtacgagcagcgaacgcttggatccctgaaggtcttctgggaccggggcgagctggtgtccaccataaagctgctggaatcgatcggcgacccgcaggtggagtggagagagctttcgccgcaggcggccgtgcaactcgagccggccctggagccggtggtcgagaaactcgccggcgtgctgcactttccgggcaacgaatcgggggacgcgcgcctgttcagcctggcagcggcggaaaaggcgcgcgagctcggcgcccgactggagttctccaccaatatcgagggtctcgagtgtgacggctggggcttccggcgggtgcgcaccgaccgcggcgtcatcgaggccgatgcctgcatcgtctgcctcggttgcgacagcccggcactgctcggcccgctgggtgtgagcgcgccgatctacccggtaaagggctactcggcgacccttcgcctggccgatcccgcccgagcaccggccggctgcgtgctcgacgccgggcagcgggtgatcgtcacccggctgggagaacgcgtgctcagggtggccggaaccgcggagttcgctggccacgatctggaaatcgaccgtgttcgggcccgctccatgctcgaaagcgcgcgtgcggtgtttccggcgcttggtccggaaatcgaggagcgcgaaccggaattctggaccgggctgcgcccgatgacccccgacggaccaccgctgctcggacgcgccggaccgcggggggtctggttgaacaccgggcatggttccatgggttggacccaggcggccggttcggccgagatcctggccgacctggtgaccggcaagtccccggccatcgacgtctcgggtatggaggcggcgcgctggaacccgtga

SEQ ID NO: 304 - protein, 422 aa, Unknown
  Obtained from environmental sample
  SIGNAL (1)...(18)
  DOMAIN (2)...(402): FAD dependent oxidoreductase
MKVLVLGAGVVGTATALALARRGLEVTLVDREPEPARGTSHANGGGITPAHAEPWNAPGIGWKLLRWLGRRDAPFRLRPAAIPGMAGWGLSFLWNSRRRRFLVNARASIRLAVYSAECLAEWREAFGLQYEQRTLGSLKVFWDRGELVSTIKLLESIGDPQVEWRELSPQAAVQLEPALEPVVEKLAGVLHFPGNESGDARLFSLAAAEKARELGARLEFSTNIEGLECDGWGFRRVRTDRGVIEADACIVCLGCDSPALLGPLGVSAPIYPVKGYSATLRLADPARAPAGCVLDAGQRVIVTRLGERVLRVAGTAEFAGHDLEIDRVRARSMLESARAVFPALGPEIEEREPEFWTGLRPMTPDGPPLLGRAGPRGVWLNTGHGSMGWTQAAGSAEILADLVTGKSPAIDVSGMEAARWNP

SEQ ID NO: 305 - DNA, 1299 bp, Unknown
  Obtained from environmental sample
atgcgagttgtcatactgggaagtggcgtcgttggcgtgaccagcgcctggtacctgagtcaggctggacatgatgtcaccgtcatcgatcgtgaaccgggcccggcgctggaaaccagcgcggcgaacgcggggcagatctctccgggctatgccgcgccctgggctgcgccgggtgtaccgctgaaggcaatcaaatggatgttccagcgccatgcgccgctggccgttcgtctggacggcacacagtttcagttgaagtggatgtggcagatgctgcgcaactgcgacaccagccactacatggaaaacaaagggcggatggtgcgtctggcggaatacagccgtgactgcctgaaagcgctacgtgcgtcgaccggcatccagtatgaagggcggcagggcgggacgctgcaactgttccgtaccgcgcagcagtatgagaacgcaacgcgcgacatcgccgtgctggaagatgccggtgtgccgtatcagttgctggaagccagccgactggcggaagtcgagccggcgctggctgaagtggcgcacaaactgaccggaggcttgcgtctgccgaatgacgaaaccggcgactgccagctctttacccagcgtctggcgcagatggccgaacaggcgggcgtcaaattccgcttcaacacgccggtggataaactgctttgcgaaggcgaacagatttacggcgtgaaatgtggtgatgagatcgttaaagccgatgcgtacgtcatggcgatgggttcctactccacggcgatgctgaaagggattgtcgatattccggtctatccgctgaaaggctattcgctgacgattccgatggcggaagaggacggcgcgccggtttcgactattcttgatgaaacctacaaaatcgccattacccgttttgaccagcgcatccgcgtgggcggcatggcggaaattgtcggtttcaataccgaactactccagccgcgtcgggaaacgcttgagatggtggtgcgcgatctctacccgcgcggtgggcatgttgaacaggcgacattctggaccggtctgcggccgatgacgccggacggtacgccagtcgtggggcgtacccgcttcaaaaatctgttattaaataccggacacggtacgctgggatggacgatggcctgtggttcagggcagttactgagcgatattctgtcaggtcgcacgcctgccattccgtatgacgatttgagcgtggcgcgctaccacgcaggctttacgccttcacgtccccaacatctgcacggcgcacataactaa

SEQ ID NO: 306 - protein, 432 aa, Unknown
  Obtained from environmental sample
  DOMAIN (2)...(397): FAD dependent oxidoreductase
  SITE (151)...(154): N-glycosylation site. Prosite id = PS00001
MRVVILGSGVVGVTSAWYLSQAGHDVTVIDREPGPALETSAANAGQISPGYAAPWAAPGVPLKAIKWMFQRHAPLAVRLDGTQFQLKWMWQMLRNCDTSHYMENKGRMVRLAEYSRDCLKALRASTGIQYEGRQGGTLQLFRTAQQYENATRDIAVLEDAGVPYQLLEASRLAEVEPALAEVAHKLTGGLRLPNDETGDCQLFTQRLAQMAEQAGVKFRFNTPVDKLLCEGEQIYGVKCGDEIVKADAYVMAMGSYSTAMLKGIVDIPVYPLKGYSLTIPMAEEDGAPVSTILDETYKIAITRFDQRIRVGGMAEIVGFNTELLQPRRETLEMVVRDLYPRGGHVEQATFWTGLRPMTPDGTPVVGRTRFKNLLLNTGHGTLGWTMACGSGQLLSDILSGRTPAIPYDDLSVARYHAGFTPSRPQHLHGAHN

SEQ ID NO: 307 - DNA, 1320 bp, Unknown
  Obtained from environmental sample
atgcaatctggcgcaccggaagccaagcgccgcattgtcgcacaagcgcgcgcaggcggccgatactggagttcgagtttgactgacacccttgtccttggcgctggaattgtcggcgtctgcgtggcgatccacctgcaacgccgcggccgcaacgtccttctcgtcgaccgcaagccgcccggacgcgagacctcctacggcaatgccggcatcatccagaaggaaggcgtgcggccacgggccttcccgcgggatctgggcgagctcctgcgtattaccgccgggaaagggctcgacacccgctacgatctcagcgcgctacccggctacgcctcgcccctcgcgcaatactggtggcactcggcaccggagcgctaccgcaagatcgtcgccgaatacgcgccgctgatcgcccacagcgtctccgagcatgccgacctcatcgcagcggccggcgccgagagcctgatcgcaaagcagggatggatggtgatcttccgcacaccccagcgccgcgacgccttcttcgccgacgccgaacgcgacagccgcgaacatggtgttggtatcgccagactcgatggggcagccttggccaaagccgagccggcccttcgcatccctatggcgggcgcgcttcactggaccgatccgtggactgtccgcgaccccggtggactggtcgccgcttatgccgcgcttttcacccggatgggcggcactatcgcaaccggcgacgcgcagacactgaaacagaacggtaccggctggtcggtcgataccgccgatggaccgcagagcgcgaccgaggccgtcattgcgttggggccatggtcacgcgccgcgaccgaaaagctcggctaccgcctgccgctcttcatcaagcgcggctaccaccgcgagtatcgtcaaaccgaagccggcaccctcaaccatccgctgctcgatgccgaaacaggcttcctcatggccccgatgcaacgcggggtgcgcatcacaaccggcgccgagttcgccggcatcgacgcgccgatcaacgcgacccagatcgacggcagcgaatccgctgcccgccagatgatcgatctcggcgaacgcctcgaccctcaaccctggctgggagcccgcccctgcacgcccgatatgaagccaatcatcggccgcgccccgaaccaccccaacctctggttcgccctcggccacgcccatcacggcctcaccctcggcgctgtgacgggccggatgcttgcagagctgttggtgggtgaaactccgttcgttgacgcagcagcgttctcggcgacgcgcttcatgtag

SEQ ID NO: 308 - protein, 439 aa, Unknown
  Obtained from environmental sample
  DOMAIN (29)...(420): FAD dependent oxidoreductase
  SITE (257)...(260): N-glycosylation site. Prosite id = PS00001
  SITE (352)...(355): N-glycosylation site. Prosite id = PS00001
MQSGAPEAKRRIVAQARAGGRYWSSSLTDTLVLGAGIVGVCVAIHLQRRGRNVLLVDRKPPGRETSYGNAGIIQKEGVRPRAFPRDLGELLRITAGKGLDTRYDLSALPGYASPLAQYWWHSAPERYRKIVAEYAPLIAHSVSEHADLIAAAGAESLIAKQGWMVIFRTPQRRDAFFADAERDSREHGVGIARLDGAALAKAEPALRIPMAGALHWTDPWTVRDPGGLVAAYAALFTRMGGTIATGDAQTLKQNGTGWSVDTADGPQSATEAVIALGPWSRAATEKLGYRLPLFIKRGYHREYRQTEAGTLNHPLLDAETGFLMAPMQRGVRITTGAEFAGIDAPINATQIDGSESAARQMIDLGERLDPQPWLGARPCTPDMKPIIGRAPNHPNLWFALGHAHHGLTLGAVTGRMLAELLVGETPFVDAAAFSATRFM

SEQ ID NO: 309 - DNA, 1242 bp, Unknown
  Obtained from environmental sample
atgcatgtaacaataattggcggtggggtaataggattatgctgcgcttattatttaaacaaagaaggatatgaagtaaccgttattgatcgcaaagatattaccgacggctgttcctttggtaatatgggttatatttcccccagccattttactccgttggcaagcccgggcattgtaagccagggattgaaatggatgttgagctcatcatctccattttatatcaaacccaggttaaactggcctcttttacgctggggaatggcattttggaaaaactccaatgcgtcaaaaatgaaggagaacattcctcatcttaataatttattacagttgagccgggaattaatgagtgaattaaaaaaagagttcgatggatcctttaccatgattgaaaaaggttgctggatgttgtatcgaaatccggcaaccggtgaacatgaaaaacatttatcagaccaggcagcagcattgggattaaaaacggtgacctgtagcaggcaggaagtgcaggaccatgaaccggaagtagaggtaaatgtggctggcggagtgttatatattgacgattgccatatcagtgctgctgagtttatgcagaccttacatcattatctggaaaatgcagaggtaaaatttttactgaatacggaagtaaatagtttcgccggcaaaaatttaatcacagaaattgtcaccagcaaagggaacgtaaagacaagtgaagtcatcatcgccaatggctcatggatgccggaactggtaaaaaaattaggcataaaaatattaatgcaacccggcaaaggctatagcgtcgtgtatgatggtcttgaaaaaaacctgcactacccatccatattggtggatgacagaacggctacaacgcccattgatcgctggttacgcataggtggaaccatggaattaagcggccacagcggtactattttaccaaaaagagtgatggctttatacaatgcattcaaaaaatattatccaacacttgacatttcacctccgcaaattgggcaagcctggtttggctatcgccctgtaactcctgatggccttccatacattggaaaattttccaaattgtctaatgtgacgttcgccggtggtcatgccatgttgggcgtatcagccgctgcggccaccgggaaactcgttgctgagatcatcagtcaccggcctactgctatcgatatagccgcatttgatccggcaagattttcctaa

SEQ ID NO: 310 - protein, 413 aa, Unknown
  Obtained from environmental sample
  DOMAIN (2)...(394): FAD dependent oxidoreductase
  SITE (97)...(100): N-glycosylation site. Prosite id = PS00001
  SITE (251)...(254): N-glycosylation site. Prosite id = PS00001
  SITE (374)...(377): N-glycosylation site. Prosite id = PS00001
MHVTIIGGGVIGLCCAYYLNKEGYEVTVIDRKDITDGCSFGNMGYISPSHFTPLASPGIVSQGLKWMLSSSSPFYIKPRLNWPLLRWGMAFWKNSNASKMKENIPHLNNLLQLSRELMSELKKEFDGSFTMIEKGCWMLYRNPATGEHEKHLSDQAAALGLKTVTCSRQEVQDHEPEVEVNVAGGVLYIDDCHISAAEFMQTLHHYLENAEVKFLLNTEVNSFAGKNLITEIVTSKGNVKTSEVIIANGSWMPELVKKLGIKILMQPGKGYSVVYDGLEKNLHYPSILVDDRTATTPIDRWLRIGGTMELSGHSGTILPKRVMALYNAFKKYYPTLDISPPQIGQAWFGYRPVTPDGLPYIGKFSKLSNVTFAGGHAMLGVSAAAATGKLVAEIISHRPTAIDIAAFDPARFS

SEQ ID NO: 311 - DNA, 1266 bp, Unknown
  Obtained from environmental sample
gtgaaagttttgatcctcggcagcggtgtcatcggtgtcacctctgcctactacctcgcacgtgccggccacgaagtgacggtcgttgaccgtcagccggaaccggcgctggagacctccttcgccaatgccggcgaagtctcgcccggctattcctcgccctgggccggtcccggcgtgccggtgaaggcgatcaagtggctgttgatgaagcacggcccgctggtgatccggccgaagctcgatcccgtgatgtgggtctggctcgccaagatgctgcgcaactgcaccagcgcgcgctacgcggtcaacaagagccggatgatcccgatcgcggagtacagccgcgattgcctgcgcgatttgcgccgcgacatcggcattcaatacgacgagcgctcgcagggcacgctgcagctcttccgctatcaggcgcagctcgacggcacggctgaggacatcgccgtgctcaagcagtacggcgtgccttacgaggtgctgagccgcgagggctgcattgcggtcgagccggcgctggcgggtgtgaaggaaaagttcgccggcgggcttcgcctgccgcaggacgagaccggcgactgccacatgttcacgcaggcgctggccaagcatgccgaagcgctcggcgtccgcttcctgttcaacaccggcatcgaccgcatcgtcacggacggcgcgcgcgtcagcggtgtcgcgaccagtgccggcatgctgcaggcagacagctacgtcctcgcgctcggaagctggtcgtcgcgcctcgttgcgccgctcggcatttcgctgccagtctatccggtgaagggttattcgatcacggtgccgatcaaggacgcctccggcgcgccggaatcgaccgtgatggacgagagctacaaggtcgcgatcacccgtctcggcaatcgcatccgcgtcggcggcaccgccgaaatctccggcttctcgagccagctctacgacgcgcgccgcgccacgctcgatcattccttgaccgacctgtttccgcgcggcggcgatctctctaaggcgacgttctggagcggcctgcgcccgatgacgcccgacggcccgcccgtgatcggcccgacgcaatacggtaacctccatctcaacaccggccacggcacgcttggctggaccatgtcgtgcggctccggccgggtgctcgcggacatgctgtcgggcaagaagccggacgtcgacgtcagtgcgctgacggcggatcggtataatcaccggtttgggtga

SEQ ID NO: 312 - protein, 421 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
MKVLILGSGVIGVTSAYYLARAGHEVTVVDRQPEPALETSFANAGEVSPGYSSPWAGPGVPVKAIKWLLMKHGPLVIRPKLDPVMWVWLAKMLRNCTSARYAVNKSRMIPIAEYSRDCLRDLRRDIGIQYDERSQGTLQLFRYQAQLDGTAEDIAVLKQYGVPYEVLSREGCIAVEPALAGVKEKFAGGLRLPQDETGDCHMFTQALAKHAEALGVRFLFNTGIDRIVTDGARVSGVATSAGMLQADSYVLALGSWSSRLVAPLGISLPVYPVKGYSITVPIKDASGAPESTVMDESYKVAITRLGNRIRVGGTAEISGFSSQLYDARRATLDHSLTDLFPRGGDLSKATFWSGLRPMTPDGPPVIGPTQYGNLHLNTGHGTLGWTMSCGSGRVLADMLSGKKPDVDVSALTADRYNHRFG

SEQ ID NO: 313 - DNA, 1245 bp, Unknown
  Obtained from environmental sample
gtggcacgtactgatgcgatggtcctcggcgccggcattgtcggcacatcggttgcgctacatctcgccaaacgcggtttgagtgtcgccttggtagaccgcgcgggcgtcggcgagcagacttcctatggcaacgccggcatcatcgaaggcaacactgtattcccgccggcatttccttccgatcttgacgcactgctccgcatcgccttcaagcgcgcgggcgaggccaactatcatttgtcgtttctgcctcgggtacttccctggctgctggcatttcgcgccgcctcgcaacccaaacgtctggcggaaacggctcgattgatccgtcccttgttttcccgggcagtcgccgagcacgaggcgttgatgaccgagtctggcgcgacgcactatttgcgcaagacaggctggttgaaggtttatcgcgaagacaggagttttgctgctttgtcgtctgagttcgatctggctgcgaaattcggcttgccgctaaagactctcgataccgcgggtgcgcaggcgctcgagccgtcgctcaatccggttttctcgcacgcggtgttctggccggaagcagccagtgtcagcagtcctcttggcgtaacgcgcgcctatgcaaaacgctttaccgcactgggcggcgtcattgtcgcaggtgacgcccagtcgctgcatcgaagcagaaaaaactggcgagtggagaccaatgaaggcgcactcgatgccgagcaatgcgtcgtggccctcgggccgtgggcgaccgatttgctggaccgcctcggcctcaaactgccgcttgccgtcaagcgaggctatcacaggcattttcgcgccgtgggcaacgccggcttggcgcgcccggtgctcgacgccgacgtgggctatctgatgacgccgatggagcagggcatccggataaccacgggtgccgaattcgcctcgcgcgatgcgccgccgagcccggcgcagttttcgcgcattacgccacgagcgcgtgaactctttccgttgggcgaactggccgaggacaagacatggctcgggagccggccgtgctttcccgattcccgcccagtgatcggccgcgcacccggattagggggcttgtggctcgcgattggccacgcccattggggcctcacactcggtccggccacaggtcggatgatcgccgaaatgatcacgggcgagcagccattttgcgatccggccccttaccgcgccgaacgcttccattag

SEQ ID NO: 314 - protein, 414 aa, Unknown
  Obtained from environmental sample
  DOMAIN (5)...(395): FAD dependent oxidoreductase
MARTDAMVLGAGIVGTSVALHLAKRGLSVALVDRAGVGEQTSYGNAGIIEGNTVFPPAFPSDLDALLRIAFKRAGEANYHLSFLPRVLPWLLAFRAASQPKRLAETARLIRPLFSRAVAEHEALMTESGATHYLRKTGWLKVYREDRSFAALSSEFDLAAKFGLPLKTLDTAGAQALEPSLNPVFSHAVFWPEAASVSSPLGVTRAYAKRFTALGGVIVAGDAQSLHRSRKNWRVETNEGALDAEQCVVALGPWATDLLDRLGLKLPLAVKRGYHRHFRAVGNAGLARPVLDADVGYLMTPMEQGIRITTGAEFASRDAPPSPAQFSRITPRARELFPLGELAEDKTWLGSRPCFPDSRPVIGRAPGLGGLWLAIGHAHWGLTLGPATGRMIAEMITGEQPFCDPAPYRAERFH

SEQ ID NO: 315 - DNA, 1236 bp, Unknown
  Obtained from environmental sample
atgtccgctgatgtcatcgtcctcggagccggcatggtcggtgcgtgcacggcgttgcagctcgcgcgtcgcgggcacgccgttgcgctggtcgatcgccgggcacccgggcgcgagacttcctacggcaacgctggaatcatccagcgcgaagcagtcgagccctatgcctttccgcgcgagtggtcggcggtcttcgacgtcgcgttcaagcgcggcatcgacgtcaactaccacctgagcgcgctgccggaggtcctgccgcggctcgcacgctactggcatgcctcggcgcccgcgcgctacgcgccgatcgcgcaggcctacagccgattgatcgagcattgcctgaccgagcatgaggttctcatcgccgagtccggtgcggacgacctcgtgcgcaaggaagggtatcgcttcgtctttcgctcgtcggccgcgatggacgaggcagcggcccgtgcggccaggctcgccgccgactacggcgtgaggcatgccgttcaggacggcgacgaattgggcagggcggaaccgggcctgcgccaacgcatggccggcgcgctgcactggctcgacccctggtccgtgagcgacccgggcgcactggtggcacgctacgcccgacgcttcgaggcgctgggcgggcaactggtcgagggcgatgcaaccagcttgcgggctgcaggtggcggatggcaggtccagacaaccgccgggccgctgactgcacgccatgccgtcgtggctctcggcccttgggcggatgcgctgatcgcaccgctcggctatcggctgcccctgttcgtcaagcgcggctaccaccgtcactatcgcggcggacccggcctgcggttgccgatgctcgatgccgaacgcggtctggtgctggcgcccatggcgcagggcgttcgccttacgacgggcgcggagttcgcccgcatcggtgcgccggccacgccggtacaactcacgaaagcggaagccgcggcgcgcgagatcctcgatctgcgggaccctgtcgaatccgagccctgggtcggcaaccgtccatgcaccgcagacatgaagccggtcatcggaccggcgccgaagcaccccggcctctggttcaacttcgggcacgcgcaccaggggttcacgctggggcctgcgagtgggcggctggtggcagacatgatcgagggagccactcccttgatcgacccggccccttatctgccaagccgcttctag

SEQ ID NO: 316 - protein, 411 aa, Unknown
  Obtained from environmental sample
  DOMAIN (4)...(393): FAD dependent oxidoreductase
MSADVIVLGAGMVGACTALQLARRGHAVALVDRRAPGRETSYGNAGIIQREAVEPYAFPREWSAVFDVAFKRGIDVNYHLSALPEVLPRLARYWHASAPARYAPIAQAYSRLIEHCLTEHEVLIAESGADDLVRKEGYRFVFRSSAAMDEAAARAARLAADYGVRHAVQDGDELGRAEPGLRQRMAGALHWLDPWSVSDPGALVARYARRFEALGGQLVEGDATSLRAAGGGWQVQTTAGPLTARHAVVALGPWADALIAPLGYRLPLFVKRGYHRHYRGGPGLRLPMLDAERGLVLAPMAQGVRLTTGAEFARIGAPATPVQLTKAEAAAREILDLRDPVESEPWVGNRPCTADMKPVIGPAPKHPGLWFNFGHAHQGFTLGPASGRLVADMIEGATPLIDPAPYLPSRF

SEQ ID NO: 317 - DNA, 1245 bp, Unknown
  Obtained from environmental sample
atgagcaaagtaactattataggaggcggcattatcgggttgagttctgcgtattatttacagcgtgcaggatgggatgttacggtaattgacaaggaggattttttggataactgttcctacggcaacgcgggctatgtttgcccgagccattttattccgctggccacaccaggcattattaagcagggtttaaaatggatgctgaattccaaaagccctttttatgttcagccaaagctgagcaaggcattgttcgactggggcttcaggtttatgaaaagtgctaccgaagagcatgtggaaaggtccgctgttcccttgcgcgatatcgctttactcagccagcaggaatatgaacaatggaccaaagaggtcggatttgatttcgcttacgagcataaaggtttattggaaatattccagaccgaagccaatgcggaacatgccaaacatactgttgagaaggcgcacaagcttggattggatactgagttgctcaattatgagcagatgcaggcactggagccacacacaaagatcaatggtttaggcgccattttctttaaatgtgatggccacctgtatcccaataaactgatgaaagggcttatcctcaagcttaaagagcttggcgttaaattattaccgcgccaggaggctgttcgttttgaaaagaaaggcaactccgttacgaaggtgattactgctgatcaaagttttgaaacagatcatgtagttgtagcaacaggatcctggagtcgtgaagtggcggctttactagatgtaagaattccgcttatgccgggcagaggctattctgtaacactagaaaattctccctacaaagttaactacccatctattttagttgaaggccgtgtggctatcacgccaatggatggtaacaagatccgtttcggcggaacgatggaagttgtatccactaatacaccgccacgctacaaccgtgttgaaggaatattaaaggctgtgaaaagcttttatcctgattttaatgtatccatgccatcaacagataagatctggtatggatacaggccatgctctgcagatggattgccctatattggcaagacaaataaatggggtaacgttaccattgctaccggtcactctatgctgggattaagtcttggcgcaggaacggggaaactggttacagagctggttaatgaaacagcgactagcattgacttgaagccttttgcggtggagagataa

SEQ ID NO: 318 - protein, 414 aa, Unknown
  Obtained from environmental sample
  DOMAIN (3)...(397): FAD dependent oxidoreductase
  SITE (38)...(41): N-glycosylation site. Prosite id = PS00001
  SITE (345)...(348): N-glycosylation site. Prosite id = PS00001
  SITE (377)...(380): N-glycosylation site. Prosite id = PS00001
  SITE (405)...(408): N-glycosylation site. Prosite id = PS00001
MSKVTIIGGGIIGLSSAYYLQRAGWDVTVIDKEDFLDNCSYGNAGYVCPSHFIPLATPGIIKQGLKWMLNSKSPFYVQPKLSKALFDWGFRFMKSATEEHVERSAVPLRDIALLSQQEYEQWTKEVGFDFAYEHKGLLEIFQTEANAEHAKHTVEKAHKLGLDTELLNYEQMQALEPHTKINGLGAIFFKCDGHLYPNKLMKGLILKLKELGVKLLPRQEAVRFEKKGNSVTKVITADQSFETDHVVVATGSWSREVAALLDVRIPLMPGRGYSVTLENSPYKVNYPSILVEGRVAITPMDGNKIRFGGTMEVVSTNTPPRYNRVEGILKAVKSFYPDFNVSMPSTDKIWYGYRPCSADGLPYIGKTNKWGNVTIATGHSMLGLSLGAGTGKLVTELVNETATSIDLKPFAVER

SEQ ID NO: 319 - DNA, 1110 bp, Unknown
  Obtained from environmental sample
ttgaaatcggcgcggccagtgaaaaccgtcggtatcgccggtgcgggcaccatgggccgcggcatcgcggccgcctgtttaaagtcaggcttgagcgtggtcctggtcgatagtgatgccaggacgctcgagcgagcccgcccggcgctggccgatagcctgacgcgcctggcgcggtcggaccaatggccggagggtgaggctgaacgaaaactcgccgccctctccctggctaataccctcgacgcccttggcagttgcgatttgatcgtcgaggctgtgtttgaggatgaagcggtgaagcgttctgctcttgctgcgatcggcaaggtcgcgcgcagcgatgcggtgatcgccacaaacacgtcatacctcgacatcgatcgcctggcggatgcctgccctgatccggcacgcttcataggcctgcacttcttcgccccggctgaaatcatgcggttggtggaagcgatccgcggcaaggccagcagcccgcagagcctcgccaccggcgtccagttcatcaggaaactcggcaaggcgcccgtgctcgccggcatgtgcgaaggattcatcgtcaaccgaattctcgccgcatatcggcgcgagatggaagttttgctggaagaaggagccctgcccgcggatgtcgacggcgccctcgagaagttcgggatggccatggggactttcgccgtcgccgatctttccgggctggacatcagctgggcgcggcgcaagcggctgcgcgccacgcagaatccgccgcctcgtttctttccggtcgccgattggctgtgcgaaagcggccgcttcggccgcaagactggcgcgggctggtatcgttatgaaggcggcaaacgcatggtcgatgaacgcgtcaccatgctgattgaacgggcctcggcggaaagcaatgttacgcggcggccaattgcgttcgaggagatcgtcgaacgggccttgtccatcatgcgaagcgaggcacagaaaattctggcagaaggcatggcgctgcgcgcgagcgatatcgacttcgccctcgtcaacgcacttggctttccggcgtggcgcggcgggccgctttatatggcccagagtaaaggatag

SEQ ID NO: 320 - protein, 369 aa, Unknown
  Obtained from environmental sample
  SIGNAL (1)...(25)
  DOMAIN (9)...(188): 3-hydroxyacyl-CoA dehydrogenase, NAD binding domain
  DOMAIN (190)...(283): 3-hydroxyacyl-CoA dehydrogenase, C-terminal domain
  SITE (122)...(125): N-glycosylation site. Prosite id = PS00001
  SITE (310)...(313): N-glycosylation site. Prosite id = PS00001
MKSARPVKTVGIAGAGTMGRGIAAACLKSGLSVVLVDSDARTLERARPALADSLTRLARSDQWPEGEAERKLAALSLANTLDALGSCDLIVEAVFEDEAVKRSALAAIGKVARSDAVIATNTSYLDIDRLADACPDPARFIGLHFFAPAEIMRLVEAIRGKASSPQSLATGVQFIRKLGKAPVLAGMCEGFIVNRILAAYRREMEVLLEEGALPADVDGALEKFGMAMGTFAVADLSGLDISWARRKRLRATQNPPPRFFPVADWLCESGRFGRKTGAGWYRYEGGKRMVDERVTMLIERASAESNVTRRPIAFEEIVERALSIMRSEAQKILAEGMALRASDIDFALVNALGFPAWRGGPLYMAQSKG

SEQ ID NO: 321 - DNA, 1248 bp, Unknown
  Obtained from environmental sample
atgaagttcgacactattgtgctgggcgcgggcatcgtaggggtatcgattgcagtgcatttgcaaaagctcggccgctcggtcgcgctcgtggatcgcaagcgtccgggcctcgagacatcgtttggaaatgccggactgctgcagcgcgaaggggtgtatccgtacgcgcttcctcgcgacatcagcacgtggatgcattacgcaaagaatgactccatcgatgtccattaccaccgcgacgcgcttcccgcgcttgcgcctttcctctggacgtactggcgcaactcggaacccgcgaagcacgcggccatcgcgcgtcaatacgcaacgctgatcgaacattgcgtgaccgagcatgaagtcctcgcgcgcgaggcgggcgtcacggatttgctcaagccaacgggctggatcaaggtcttccacaccaacgccgcacaggacgatgaagcgcgcgatgcagaacgctggcatcgtgaattcggtgtgcattacacgctgctcgatcctgccacgttgcagaagaccgagccgcatctggacccatcgctagtgggcggattgcattacacggacgcggtatcggtcaatgatccgggcgcgctggtcgcgggttatgccgcgtatttcgagcggctgggcggacgtttcttcaacggcgacgcgaccacccttgccgaagatggcaacggctggcgcgtgatgacggaggaagggcaggtcaacgcatcgactgcagtgatcgcgctggggccatgggcgaaggacgtgaccgcggcgctgggatatcggttgccgctcgcggtgaagcgcggctatcacatgcactacacgccgcagccgggcacggtgctgaaccatccggtactcgatgtcgacaacggtttcctgcttgcgccaatggcgcgcggcatccgcctgacgacaggcgtggagctggccgaacgcgatgcgccgaagacacccgtgcaactgctgcgcgccgagcctgtggcgcggactctgttcccgctcggggagcgtgtagacgatgaaccctggatgggccgccgtccgtgcacgcctgacatgatgccgatcatcggacctgcgccgcgtcacaagaacatgtggttcgcattcggccacgcgcatcatgggctcacgctcggcgcggtgacgggcaggctgattgcatccatgatgacgggtgaagaaccgttcatcgataccacgccgttcagggcagaccgctttgcggcttag

SEQ ID NO: 322 - protein, 415 aa, Unknown
  Obtained from environmental sample
  DOMAIN (4)...(395): FAD dependent oxidoreductase
  SITE (72)...(75): N-glycosylation site. Prosite id = PS00001
  SITE (246)...(249): N-glycosylation site. Prosite id = PS00001
MKFDTIVLGAGIVGVSIAVHLQKLGRSVALVDRKRPGLETSFGNAGLLQREGVYPYALPRDISTWMHYAKNDSIDVHYHRDALPALAPFLWTYWRNSEPAKHAAIARQYATLIEHCVTEHEVLAREAGVTDLLKPTGWIKVFHTNAAQDDEARDAERWHREFGVHYTLLDPATLQKTEPHLDPSLVGGLHYTDAVSVNDPGALVAGYAAYFERLGGRFFNGDATTLAEDGNGWRVMTEEGQVNASTAVIALGPWAKDVTAALGYRLPLAVKRGYHMHYTPQPGTVLNHPVLDVDNGFLLAPMARGIRLTTGVELAERDAPKTPVQLLRAEPVARTLFPLGERVDDEPWMGRRPCTPDMMPIIGPAPRHKNMWFAFGHAHHGLTLGAVTGRLIASMMTGEEPFIDTTPFRADRFAA

SEQ ID NO: 323 - DNA, 1245 bp, Unknown
  Obtained from environmental sample
atgcattgccagacccttgtcctcggcgccggcatcgtcggcgtcagcaccgcgctgcacctgcaggcccgcgggcgccaggtgatcctgatcgaccgcgacgaaccgggcagcggcaccagccacggcaacgccgggttgatcgagcgctccagcgtcatcccctatgcctttccccggcaactgggcgcattgctgcgctacggcctgaaccgccagcccgatgtgcgctacagcctggcgcacctgcccaaggccgcgccgtggctgtggcgctactggcgtcagtcagcccctggtcggctggccggtgccgccgctgacatgctgccgctggtgcagcgctgcgtcgaagaacacgacgcgctcatcgctgctgccggccttgaagggctggtgcaggccaaagggtggatcgaagtgttccgcgacccggccctgttcgagcaggccaaggccgacgccaagggcctgagccgctatggcctgcaatttgaaatccttgaatgcgggcaactgcaggcccgcgagcaccagctggacgccaccgtggtcggcggcatccactggctcgacccgaagaccgtgaacaaccccggcgccctcacccgtggctacgcggcgctgttccagcaacgcggcgggcagttcctgcatggtgatgcacgcagcctgcgtcaggccaacggccaatggcgggtcgagagccgccgcggcccgattaccgccgacgaagtggtggcctgcctaggcccacagtcggccgacctgttcagcggcctgggctaccagatcccgctggcgatcaagcgcggttaccacatgcactacagcacccgtgacggcgcgcaactggagcattccatttgcgacacccagggcggctatgtgctggcaccgatggcgcgcggtgtgcgcctgaccaccggcatcgagttcgacgcagccagcgcgcccggcaaccagatccagctgggccgctgcgaggccctggcgcgcaagctgttcccggccttgggcgaacgcctcgatgacacgccgtggctgggccgtcgcccgtgcctgcccgacatgcgcccggtgatcggcccggcaccccgccacccggggctgtggttcaacttcggccacgcccaccacgggctcaccctgggcccggtcagcggtcggctggtggccgagctgatcaccggcgaacaccccttcaccgaccccgcgccctacagcgcgacccgtttcgactga

SEQ ID NO: 324 - protein, 414 aa, Unknown
  Obtained from environmental sample
  DOMAIN (4)...(395): FAD dependent oxidoreductase
MHCQTLVLGAGIVGVSTALHLQARGRQVILIDRDEPGSGTSHGNAGLIERSSVIPYAFPRQLGALLRYGLNRQPDVRYSLAHLPKAAPWLWRYWRQSAPGRLAGAAADMLPLVQRCVEEHDALIAAAGLEGLVQAKGWIEVFRDPALFEQAKADAKGLSRYGLQFEILECGQLQAREHQLDATVVGGIHWLDPKTVNNPGALTRGYAALFQQRGGQFLHGDARSLRQANGQWRVESRRGPITADEVVACLGPQSADLFSGLGYQIPLAIKRGYHMHYSTRDGAQLEHSICDTQGGYVLAPMARGVRLTTGIEFDAASAPGNQIQLGRCEALARKLFPALGERLDDTPWLGRRPCLPDMRPVIGPAPRHPGLWFNFGHAHHGLTLGPVSGRLVAELITGEHPFTDPAPYSATRFD

SEQ ID NO: 325 - DNA, 1299 bp, Unknown
  Obtained from environmental sample
atgcgagttctggtacttggtagcggcgtaatcggaaccgccagtgcctactacctggcccggcaaggtttcgaagtgacggtggtcgaccgccagccggcggtggccatggaaaccagttttgccaacgccggtcagatctcgcccggctatgcctcgccctgggccgcacctggtgtaccgctgaaggccgtgaagtggctgctggagcgccacgcccctctggccatcaagctgaccggtgacgtcgaccagtacctgtggatggcgcagatgctgcgcaactgcactgccagccgttatgcggtgaacaaggagcgcatggtgcgcctgtccgagtacagccgtgactgcctcgacgagctgcgcgccgaaaccggcatcaattacgaaaaccgcagcctgggcactacccaactgttccgtacccaggcccaggttgatgctgcggccaaggacattgccgtgctcgaacagtccggcgtgccttacgaattgctcgaccgcgacggcattgcccgcgttgaaccggccctggctggcgtgaaagacatcctggccggcgccctgcgcttgcccaacgaccaaactggcgactgccagttgttcaccaccaagctcgccgacatggcgctgaagctgggcgtggagttccgctttggccaggacatccagcgcctggacttcgccggcgaccgcatcaacggtgtgtggatcgacggcaagctggaaaccgccgaccgctacgtgctggcgctgggcagctactcgccgcagatgctcaagccgctgggcatcaaggccccggtctatccgctgaaaggctactcgctgaccgtgccgatcaccaacggcgacatggccccgacgtcgaccatcctcgacgaaacctacaaggttgcgatcacccgtttcgacaatcgcatccgcgtcggcggcatggctgaaatcgccggttttgacctgtcgctgaacccgcgtcggcgcgaaacgctggagatgatcgtcaacgacctttatcctcgcggcggtgacctgagccaagccagtttctggaccggcctgcgcccggcgaccccggacggtacaccgattgtgggtgcgaccgcgttccgcaacctgttcctgaacaccggtcacggtactttgggctggaccatggcgtgcggctccggtcgtctgctggccgacctgattgcgcgcaagaagccgcagatcagtgccgaaggcctggacatttcccgttatggcaacagcccggaagtggccaagcatgggcaggctgcaccctcgtgccga

SEQ ID NO: 326 - protein, 433 aa, Unknown
  Obtained from environmental sample
  DOMAIN (2)...(398): FAD dependent oxidoreductase
  SITE (96)...(99): N-glycosylation site. Prosite id = PS00001
  SITE (134)...(137): N-glycosylation site. Prosite id = PS00001
MRVLVLGSGVIGTASAYYLARQGFEVTVVDRQPAVAMETSFANAGQISPGYASPWAAPGVPLKAVKWLLERHAPLAIKLTGDVDQYLWMAQMLRNCTASRYAVNKERMVRLSEYSRDCLDELRAETGINYENRSLGTTQLFRTQAQVDAAAKDIAVLEQSGVPYELLDRDGIARVEPALAGVKDILAGALRLPNDQTGDCQLFTTKLADMALKLGVEFRFGQDIQRLDFAGDRINGVWIDGKLETADRYVLALGSYSPQMLKPLGIKAPVYPLKGYSLTVPITNGDMAPTSTILDETYKVAITRFDNRIRVGGMAEIAGFDLSLNPRRRETLEMIVNDLYPRGGDLSQASFWTGLRPATPDGTPIVGATAFRNLFLNTGHGTLGWTMACGSGRLLADLIARKKPQISAEGLDISRYGNSPEVAKHGQAAPSCR

SEQ ID NO: 327 - DNA, 1254 bp, Unknown
  Obtained from environmental sample
atgacagcagcaaagtcggacgttctgattctcggcggcggcgtgatcggtctcgcctgcgcgcattacctgctcgaggccggccgcagcgtgaccgtgctcgaacaggcgacgctcggcagcggcagctcgcacggcaactgcggcacgctgacgccgagccacgcgacgccgctggcgatgccgggcgtgatcggcacggcgctgcgctggctgctgaaacccgatgcaccgctgcgcatcaagccgcgtttcgatccggcgctgctgcgctggctgctcggtttcgccgcgcattgcaattggcaggatgccgtgcgcgcgacgatggcgaaggcgccgctgctgatccgctcgcgcgagctgatcgaggagctcgtgcgcacacagcggctcgcctgcgaattcgaagcgctcggcaccttgaacgtatttcgcgacgcggcgaatttcgagcacgcgcgcgaatcgctgtcgctgctcgccgatgccggcatccgcgtcgatgtgctcgatgcggcgcaaacgctcgcgcgcgaaccggcgctcaagcccggtgtcgccggcgcgttcttcaatccaggcgacgcccagctacgcccggatcgatatgtcgcggaactggcgcgctgcgtgcgtacacgcggcggacggatcgaggaaggcgcgcgcatcgatggcttgctgcttgaaggcagccgcatcgtcgaggcgacgacgtcgaaaggcagcttcagcgggcgcgatgtcgtgttcgcgctcggtgcgtggtcgccggcgctggcacgtccgctcggtctgcgcattccaatccagccgggcaagggttattcgatcacctatacacgcccgctgcgctgcccgcgcattccgatgaccttgaaggaaccgagcgtgtgcgtgacggcctggggctcaggtttccgcctcggcagcacgatggaattcgccggctatgacggtaccctcaatcgcacgcgactggatgcgctgaaacgcggcgcgtcgacgttcctgcacgaaccggaaggtcccgctctcgtcgaggagtggtacggctggcggccgatgacgccggacgacctaccgttgctcggccgcgcgcccggcatcgacaatctcgtgttggcgaccggtcatggcatgctcggcgtcagtctttctgcgataacggggctgctggtgagcgagatcgttgtgggcgttccgccttctttcgatctggcgccgtttgccgcagcgcgctttcagtga

SEQ ID NO: 328 - protein, 417 aa, Unknown
  Obtained from environmental sample
  DOMAIN (7)...(398): FAD dependent oxidoreductase
MTAAKSDVLILGGGVIGLACAHYLLEAGRSVTVLEQATLGSGSSHGNCGTLTPSHATPLAMPGVIGTALRWLLKPDAPLRIKPRFDPALLRWLLGFAAHCNWQDAVRATMAKAPLLIRSRELIEELVRTQRLACEFEALGTLNVFRDAANFEHARESLSLLADAGIRVDVLDAAQTLAREPALKPGVAGAFFNPGDAQLRPDRYVAELARCVRTRGGRIEEGARIDGLLLEGSRIVEATTSKGSFSGRDVVFALGAWSPALARPLGLRIPIQPGKGYSITYTRPLRCPRIPMTLKEPSVCVTAWGSGFRLGSTMEFAGYDGTLNRTRLDALKRGASTFLHEPEGPALVEEWYGWRPMTPDDLPLLGRAPGIDNLVLATGHGMLGVSLSAITGLLVSEIVVGVPPSFDLAPFAAARFQ

SEQ ID NO: 329 - DNA, 1251 bp, Unknown
  Obtained from environmental sample
atgagtaatataacagtagttggcggaggcattatcggtttaagctctgcattttatcttcaaaaagccggacataaagttaccgtaattgacaaagatgatttctcaaacaattgctcgtacgggaatgcgggctatgtttgccccagccattttgttccgctggcaacaccgggcatagtatggaaggggtttaaatggatgttcaattcgcaaagcccgttttatgtgcaaccgtctctgaaaagcgcattgattgactggggggtaaaatttgcgaaaagcgccaatgataagcacgtggcagcttcggctatccctttacgtgatatagctattttaagtcagaaagaatatgaacaatggacaaccataccgggttttgattttgcgtatgagcataagggtctgcttgaaatttttcagacagaagcggtgggtgagcacgcccgtcacacggttgaaaaagcaaacgcattaggcctggatactaagtttttgaatgcggatgaattgcagcaattagaaccgcaaacaaaaattaaagctttgggcgccatactgtttaaatgtgatgcccacctgtacccgcagaaattaatgcatgggttattaaatatattaaagcagagcggtgtgcagctggtacccaacgaaacagtaataagattcgagaaaaaaggaaacagcattaacaaggtgatcactgcaaccaatacttatgataccgaccaggttgttattgccaccggcgcctggacgcgggaaatagcctcactggctgatacaaaaattccattgatgcccgggcgcggttattccattaccctcgaaaattcaccttaccgcatcaatcatcctgctgtgctgatagaaggcagggttgctctcacaccgatggacggaaacaaaataaggtttggcggaactatggaagtggtgcctacggatactcccccacgttacaaacgtgtggaaggcattatcaatgccgttaaaagatactacactgaatttgacattcccatgccgcatgaaaaagacatctggtatggttacagaccctgctcggcagacgggcttccttatatcggcaaaataaaacggtataacaatgtggttatagccaccggtcatgccatgatcggtttaagcacaggcgcaggaacgggcaggctggtatctgaaattgtgaatgagcaaaaaacaagtatagatattattccttttgctgtggaaaggttcggttaa

SEQ ID NO: 330 - protein, 416 aa, Unknown
  Obtained from environmental sample
  DOMAIN (3)...(397): FAD dependent oxidoreductase
  SITE (3)...(6): N-glycosylation site. Prosite id = PS00001
  SITE (38)...(41): N-glycosylation site. Prosite id = PS00001
  SITE (221)...(224): N-glycosylation site. Prosite id = PS00001
  SITE (292)...(318): Ribosomal protein L14 signature. Prosite id = PS00049
MSNITVVGGGIIGLSSAFYLQKAGHKVTVIDKDDFSNNCSYGNAGYVCPSHFVPLATPGIVWKGFKWMFNSQSPFYVQPSLKSALIDWGVKFAKSANDKHVAASAIPLRDIAILSQKEYEQWTTIPGFDFAYEHKGLLEIFQTEAVGEHARHTVEKANALGLDTKFLNADELQQLEPQTKIKALGAILFKCDAHLYPQKLMHGLLNILKQSGVQLVPNETVIRFEKKGNSINKVITATNTYDTDQVVIATGAWTREIASLADTKIPLMPGRGYSITLENSPYRINHPAVLIEGRVALTPMDGNKIRFGGTMEVVPTDTPPRYKRVEGIINAVKRYYTEFDIPMPHEKDIWYGYRPCSADGLPYIGKIKRYNNVVIATGHAMIGLSTGAGTGRLVSEIVNEQKTSIDIIPFAVERFG

SEQ ID NO: 331 - DNA, 1266 bp, Unknown
  Obtained from environmental sample
ttgaacgttctcattcttggcggcggcgtcattggcgtgacgtctgcctactatcttgccaaagcgggccatgcggtcacggtcgtcgaccgccagcccgatgttgcccttgaaacatcattcgccaacgccggcgaggtatcgcccggttatgcctcaccctgggccggccccggcgtgccgataaaagcgatcaaatggttgttaatgacgcacggcccgctggtgatccggcccaagctcgatcccgcaatgtgggtcttcatggccaagatgctgcgcaactgcaccgatgcgcgctacgcggtcaacaagggccggatgattccgatcgcagagtatagccgtgactgcctgcgcgcgctgcgcgccgacattggcattcactatgatgagaagagccgcggcacactgcagctgttccgcaagcaggaacagcttgatcacactggcggcgatattgccgtgctcaagcagtatggcgtgccttatgaggtgctcgaccgcaccggctgcatcgccgccgagcctgcgcttgccgcagtaaaaggcaagtttgttggcggtctgcgcctgccccaggacgagaccggcgattgccacatgtttacccaggcgcttgccgcacgcgcggcagagcttggcgtgcagttcaaatttgcgacctcgatccagcagcttattgttgagggcaagcacgtctccggcgttgccacctcggccgggctcatgaaggctgacgcctatgtcgtcgcgctcgggagctggtcgccgcatctgctgcggccgctcggcatctcgatccccgtctatcccgtcaagggctattccatcaccgtgccggtggccgacacggccgctgcgccggtctcgaccgtgatggacgagagctacaaggtcgcgatcacgcggcttggaaagcgcattcgcgtcggaggtaccgcggagatctcaggctactccaacactctgcacgccgcgcggcgtgccacgcttgaccattcgctgactgacctgtttccgggcggcggcgatctcagggatacaaagttctggagcggcctgcgcccgatgacgcctgacggcccgccgctgatcgggccgacaccttatgcgaacctgcatctcaacaccggccacggcacgctgggatggacaatggcgtgcggctccgggcgcgtgcttgcggataccttgagcggccgcaagccggacgtcgacatcagcgaactcgcgatgacacgttacgagacgcgcttcgggtga

SEQ ID NO: 332 - protein, 421 aa, Unknown
  Obtained from environmental sample
  DOMAIN (2)...(398): FAD dependent oxidoreductase
  SITE (96)...(99): N-glycosylation site. Prosite id = PS00001
MNVLILGGGVIGVTSAYYLAKAGHAVTVVDRQPDVALETSFANAGEVSPGYASPWAGPGVPIKAIKWLLMTHGPLVIRPKLDPAMWVFMAKMLRNCTDARYAVNKGRMIPIAEYSRDCLRALRADIGIHYDEKSRGTLQLFRKQEQLDHTGGDIAVLKQYGVPYEVLDRTGCIAAEPALAAVKGKFVGGLRLPQDETGDCHMFTQALAARAAELGVQFKFATSIQQLIVEGKHVSGVATSAGLMKADAYVVALGSWSPHLLRPLGISIPVYPVKGYSITVPVADTAAAPVSTVMDESYKVAITRLGKRIRVGGTAEISGYSNTLHAARRATLDHSLTDLFPGGGDLRDTKFWSGLRPMTPDGPPLIGPTPYANLHLNTGHGTLGWTMACGSGRVLADTLSGRKPDVDISELAMTRYETRFG

SEQ ID NO: 333 - DNA, 1110 bp, Unknown; identical to SEQ ID NO: 319
  Obtained from environmental sample

SEQ ID NO: 334 - protein, 369 aa, Unknown; identical to SEQ ID NO: 320
  Obtained from environmental sample
  SIGNAL (1)...(25)
  DOMAIN (9)...(188): 3-hydroxyacyl-CoA dehydrogenase, NAD binding domain
  DOMAIN (190)...(283): 3-hydroxyacyl-CoA dehydrogenase, C-terminal domain
  SITE (122)...(125): N-glycosylation site. Prosite id = PS00001
  SITE (310)...(313): N-glycosylation site. Prosite id = PS00001

SEQ ID NO: 335 - DNA, 1248 bp, Unknown; identical to SEQ ID NO: 321
  Obtained from environmental sample

SEQ ID NO: 336 - protein, 415 aa, Unknown; identical to SEQ ID NO: 322
  Obtained from environmental sample
  DOMAIN (4)...(395): FAD dependent oxidoreductase
  SITE (72)...(75): N-glycosylation site. Prosite id = PS00001
  SITE (246)...(249): N-glycosylation site. Prosite id = PS00001

SEQ ID NO: 337 - DNA, 1248 bp, Unknown
  Obtained from environmental sample
atggcacgtacggacgccatcgttctcggcgcgggcatcgtcggcacctcgatcgcgctgcatctcgtcaaacgaggcttgagcgtcgcgctggtcgatcgcggggggccgggcgaggaaacctcatacggcaacgccggcatcatcgaaggcaacacgcttttcccgcacgcctttccgtccgatccggcggcgctcgcgcgcatcatcttcaagcaggcgacggaagcgaactatcatctctcgtatctgccgaaggcattgccgtggttgctcgcgtaccggaagtggacgcagccggacaagctcgtcgagcatgcgcatatggtgcggccgcttttttcccgcgcggcgcccgagcacgaagcgctgatggcggaatcgaacgctacgcactatttgcgcaaaaccggctggctcaagctttatcgcaccgaacagcatttcgcctcgatgcagcgcgagctcgatctcgcggccaaattcggcctgccggtgaaggcgatcggcaccgacgaggcgcgcgcgctcgagccgtcgctcgcgccggtctttccgcgtgcgatcttctggacggacgcagcgagcgtcagcaatccgctgggcgtcacgcgcgcttatgcggcgcgctacgcggagttcggcggagtgacggtgaaaggcgatgcgctttcgctgcaccggacgggcgaccgctggcgcgtcgagacggatgaaggcccgctcgatgcaggcgatattgtcgtggcgcttgggccttgggcgggcgatttattgcagcgtttcgatctcaagctgccgctcggttacaagcgcggctatcaccggcattttggcgcgcgcggcaatgccggcctgtcgcgaccggtgctcgattcaaccgccggctacctgatcgcgccgatggagcagggcctccgcatcacgagcggcgccgaaatcgccgcgcgcgacgcgccgccgacgcccgtgcaattcgaccggctgctgccgaaggcgcgggagcttttcccgctcggcgatcaggtggacaacaagacgtggatgggcgtgcggccgtgctttgcggattcgcggccggtcatcgggcgcgcgccgaatctgcgcgggctatggcttgccatcggacacgcgcattggggcctgacgctcgggccggcgaccgggcgcatgatcgccgagatgatgacgggcaacacgccgttctgcgatccggcgccataccgtgccgaacgcttccttcagtga

SEQ ID NO: 338 - protein, 415 aa, Unknown
  Obtained from environmental sample
  DOMAIN (5)...(395): FAD dependent oxidoreductase
  SITE (350)...(353): N-glycosylation site. Prosite id = PS00001
  SITE (368)...(380): Lipocalin signature. Prosite id = PS00213
MARTDAIVLGAGIVGTSIALHLVKRGLSVALVDRGGPGEETSYGNAGIIEGNTLFPHAFPSDPAALARIIFKQATEANYHLSYLPKALPWLLAYRKWTQPDKLVEHAHMVRPLFSRAAPEHEALMAESNATHYLRKTGWLKLYRTEQHFASMQRELDLAAKFGLPVKAIGTDEARALEPSLAPVFPRAIFWTDAASVSNPLGVTRAYAARYAEFGGVTVKGDALSLHRTGDRWRVETDEGPLDAGDIVVALGPWAGDLLQRFDLKLPLGYKRGYHRHFGARGNAGLSRPVLDSTAGYLIAPMEQGLRITSGAEIAARDAPPTPVQFDRLLPKARELFPLGDQVDNKTWMGVRPCFADSRPVIGRAPNLRGLWLAIGHAHWGLTLGPATGRMIAEMMTGNTPFCDPAPYRAERFLQ

SEQ ID NO: 339 - DNA, 1245 bp, Unknown
  Obtained from environmental sample
atggctaaaataataattatcggcggtggtattattggattaagttctgcttattatctcaaacgttcgggctgggatgtcactgttctcgacaaaagcgatttttcagacaactgctcttatggcaacatgggttacgtttgtccaagtcattttattccgttagcagcaccgggtattgtaaaacaaggattcaaatggatgtggaactcgcagagtcctttctacgttcagccgaggttgaatggtgcattaattaactgggggatgaaatttattcgcagcgcatccaaaaaaaatgtggaagaatctgccataccacttcgtgatattgctttgcttagtcagcaggaatatgtagaatggaaaaaggaatttgatttttcttacgagcacaaagggttgttggagatatttcagacagaggcaaaggctgagcatgcaaagcatacggttgaaaaagcaaaagagcttggtttggatactgaattgctttcttataatgagctgcagcaattggagccgcatacaaccatcaatgcccttggcgccatcatttttaaatgcgatgcacatttgtttcccgataaactgatgaaagggttaatcgataaattaaaacaatcgggagttgaactgaaacctaatgaagaagtaataaaatttgaaaagaatggaaaggcagtttcaaagattatcacacaaaataaaacatatgaggtagataaggttgtaatagcggccggtgcatggagtcgcgagttaacctcaatgataaatatcaatcttccattgatcccgggtcgtggatattcggttacattggaaaattctccctacaaagtcaattatcctgctgtattgatggaaggaagaacggcgatcacaccgatggatggaaataagatacggttcggcggaacaatggaaattacttctgtcaacaagcccccaagggtaaaccgggtaagaggcattttgaatgcggtcaaacgtttttatcccgagtttgatgtaccaatgccagccgaagacaaaatatggtatggctatcgtccctgttcggcggatggattgccttatatcggtaaagtaaagaaattgaataacgtggtcatagcaacaggtcattcaatgcttggattaagtttgggtgcgggtactggtaagctggtgagcgagatcattaatgaaacacgggtgagtatggatatcaccccatttaatgttgaacgttttggataa

SEQ ID NO: 340 - protein, 414 aa, Unknown
  Obtained from environmental sample
  DOMAIN (3)...(395): FAD dependent oxidoreductase
  SITE (38)...(41): N-glycosylation site. Prosite id = PS00001
  SITE (239)...(242): N-glycosylation site. Prosite id = PS00001
  SITE (403)...(406): N-glycosylation site. Prosite id = PS00001
MAKIIIIGGGIIGLSSAYYLKRSGWDVTVLDKSDFSDNCSYGNMGYVCPSHFIPLAAPGIVKQGFKWMWNSQSPFYVQPRLNGALINWGMKFIRSASKKNVEESAIPLRDIALLSQQEYVEWKKEFDFSYEHKGLLEIFQTEAKAEHAKHTVEKAKELGLDTELLSYNELQQLEPHTTINALGAIIFKCDAHLFPDKLMKGLIDKLKQSGVELKPNEEVIKFEKNGKAVSKIITQNKTYEVDKVVIAAGAWSRELTSMININLPLIPGRGYSVTLENSPYKVNYPAVLMEGRTAITPMDGNKIRFGGTMEITSVNKPPRVNRVRGILNAVKRFYPEFDVPMPAEDKIWYGYRPCSADGLPYIGKVKKLNNVVIATGHSMLGLSLGAGTGKLVSEIINETRVSMDITPFNVERFG

SEQ ID NO: 341 - DNA, 1248 bp, Unknown
  Obtained from environmental sample
atgaagttcgacactattgtgctgggcgcgggcatcgtaggggtatcgattgcagtgcatttgcaaaagctcggccgctcggtcgcgctcgtggatcgcaagcgtcccggcctcgagacatcgtttggaaatgccggactgctgcagcgcgaaggggtgtatccgtacgcgcttcctcgcgacatcagcacgtggatgcattacgcaaagaatgactccatcgatgtccattaccaccgcgacgcgcttcccgcgcttgcgccgttcctctgggcgtactggcgcaactcggaacccgcgaagcacgcggccatcgcgcgtcaatacgcaacgctgatcgaacattgcgtgaccgagcatgaggtcctcgcgcgcgaggcgggcgtcacggctttgctcaagccaacgggctggatcaaggtcttccacaccaacgccgcacaggacgatgaggcgcgcgatgcagaacgctggcatcgtgaattcggtgtgcattacacgctgctcgatcctgccacgttgcagaagaccgagccgcatctggacccatcgctggtgggcggattgcattacacggacgcggtatcggtcaatgatccgggcgcgctggtcgcgggttatgccgcgtatttcgagcggctgggcggacgtttcttcaacggcgacgcgaccacccttgccgaagatggcaacggctggcgcgtgatgacgcaggaagggcaggtcaacgcatcgactgcagtgatcgcgctggggccatgggcgaaggacgtgaccgcggcgctgggatatcggttgccgctcgcggtcaagcgcggctatcacatgcactacacgccgcagccgggcacggtgctgaaccatccggtactcgatgtcgacaacggtttcctgcttgcgccaatggcgcgcggcatccgcctgacgacaggcgtggagctggccgaacgcgatgcgccgaagacacccgtgcaactgctgcgcgccgagcctgtggcgcggactctgttcccgctcggggagcgtgtagacgatgaaccctggatgggccgccgtccgtgcacgcctgacatgatgccgatcatcggacctgcgccgcgtcacaagaacatgtggttcgcattcggccacgcgcatcatgggctcacgctcggcgcggtgacgggcaggctgattgcatccatgatgacgggtgaagaaccgttcatcgataccacgccgttcagggcagaccgctttgcggcttag

SEQ ID NO: 342 - protein, 415 aa, Unknown
  Obtained from environmental sample
  DOMAIN (4)...(395): FAD dependent oxidoreductase
  SITE (72)...(75): N-glycosylation site. Prosite id = PS00001
  SITE (246)...(249): N-glycosylation site. Prosite id = PS00001
MKFDTIVLGAGIVGVSIAVHLQKLGRSVALVDRKRPGLETSFGNAGLLQREGVYPYALPRDISTWMHYAKNDSIDVHYHRDALPALAPFLWAYWRNSEPAKHAAIARQYATLIEHCVTEHEVLAREAGVTALLKPTGWIKVFHTNAAQDDEARDAERWHREFGVHYTLLDPATLQKTEPHLDPSLVGGLHYTDAVSVNDPGALVAGYAAYFERLGGRFFNGDATTLAEDGNGWRVMTQEGQVNASTAVIALGPWAKDVTAALGYRLPLAVKRGYHMHYTPQPGTVLNHPVLDVDNGFLLAPMARGIRLTTGVELAERDAPKTPVQLLRAEPVARTLFPLGERVDDEPWMGRRPCTPDMMPIIGPAPRHKNMWFAFGHAHHGLTLGAVTGRLIASMMTGEEPFIDTTPFRADRFAA

SEQ ID NO: 343 - DNA, 693 bp, Unknown
  Obtained from environmental sample
atggaaaccgtattgatcacaggcgccaatcgcggcatcggtctcgaactcgccgcgcgctacgccgccgccggcaatcgcgtgctggcgtgctgccgcgatccgaagaaagccgaccagctgcaagcgctcgcgaagtcgcgcaaaggtctcaccgtgcacggcgtacacgtcgccgacggcaaatcggtcgccgcactcgcggccgacgtgaaggagccgatcgacatcttgatcaacaacgccggcatgccgggtcccgcggcagacaagcaatcggtcgccaacatggacttcgacggctgggccgagacgttcgccgtcaacacgatggcaccgctgcggatgctgcaagcgtttcgccgcaacttgaaagccggcaagaacgcgcgcgccattacgatcaccagccaaatgggcgcgctatcgctcaacatgccggtgatgttcgcgtactgctcgtcgaaggcggccgtcaacaaggtgatgaacatggcgtcggtcgaactcgcgaacgacggcatcaccgtcggcctgattcatcccggttgggtccgcaccgacatgggcggcaagaacgccgacttgagcgtcgaggacagcgccgcggggatcatggcgacgatcgccaaatggacgcccgccgagaccggctcgttcaagaaatggaacggcgaaacgcacggctggtaa

SEQ ID NO: 344 - protein, 230 aa, Unknown
  Obtained from environmental sample
  DOMAIN (2)...(171): short chain dehydrogenase
METVLITGANRGIGLELAARYAAAGNRVLACCRDPKKADQLQALAKSRKGLTVHGVHVADGKSVAALAADVKEPIDILINNAGMPGPAADKQSVANMDFDGWAETFAVNTMAPLRMLQAFRRNLKAGKNARAITITSQMGALSLNMPVMFAYCSSKAAVNKVMNMASVELANDGITVGLIHPGWVRTDMGGKNADLSVEDSAAGIMATIAKWTPAETGSFKKWNGETHGW

SEQ ID NO: 345 - DNA, 1260 bp, Unknown
  Obtained from environmental sample
atgcgcgcgctcgtcctcggtagcggactcgccggcgtcacggcggcgtactacctgcgcaagaacggtctcgacgtcaccgtcgtcgatcgcgcggcggggccggggcgcgagacgagtttcgcgaacggctccatgatcacgccgagcctcgccgacccgtggaattcgccgggcgtgctcggcgtgttgctgcgttcgctcgggcgcgaggactcgccgatgttgttgcggccgtcggtgttgccgtcgctgttcggttggggcatcgcgtttctgcggaactcctcgcaacgcaatttcgaacgcaactatctgcgcaacgtcgcgctggtccactactcgcaatggatcatgcgcgatctgctgcagacgcatccgctcgcgttcgaccacgcgtacgacggcacggtgaagatctttcgcgatccgcgcgcgttcgactacggcatcaaggtcgcgcatttcctgaagcaatccggcgtgcagcatcggccgctcgaccgcgccgcgctgctcgaaacggaacccgagctgcgctcggtcatcgacgagatctgcggcggcatcgcgtatcccggcgacgagaccggcaacgcgcgactcttctgcgaagaactgcgtcgcgtatgcgccgccgacggcgtgacgttccgcttcgccgaaaacgtcgtcgacatcgagacctggcgcaagcgcgtggcgggcctgcgcaccgcaaaggaaacgttggtggccgacgtgtatgtcctcgccgcgggcagcttcagcgcgacgtgggcgaaacacctcggtttcgacctgccggtgcggccggcgaagggctattcgatcagcgtgccgatgcatcgatgggagcgtcgcccgcgcgtaccgatcgtcgacgattcgttgcacgcagcgctggtaccggtcggcggcgtgttgcgcgtcgccggtaccgccgagttcgcgggttacgacacgacggtgcggccggaacgcatcgacaacctgcgcgggctgctgcggcgcgtgtatccgcagttcgccgagtccgccgatagcgtcgacattcaaccgtggtgcggcctgcggccgctgacgccggacggcatgccgatcgtgggccgcacgccgctcgagaatctctacgtcaacacgggccacggtccgctcggttggtcgatggcctgcggctcgggtaaggcggtcgccgacattgcggcgggtcacgcggccgacctcgacatgactccgttcgcgctgacgcgtttctga

SEQ ID NO: 346 - protein, 419 aa, Unknown
  Obtained from environmental sample
  DOMAIN (2)...(401): FAD dependent oxidoreductase
  SITE (43)...(46): N-glycosylation site. Prosite id = PS00001
  SITE (96)...(99): N-glycosylation site. Prosite id = PS00001
MRALVLGSGLAGVTAAYYLRKNGLDVTVVDRAAGPGRETSFANGSMITPSLADPWNSPGVLGVLLRSLGREDSPMLLRPSVLPSLFGWGIAFLRNSSQRNFERNYLRNVALVHYSQWIMRDLLQTHPLAFDHAYDGTVKIFRDPRAFDYGIKVAHFLKQSGVQHRPLDRAALLETEPELRSVIDEICGGIAYPGDETGNARLFCEELRRVCAADGVTFRFAENVVDIETWRKRVAGLRTAKETLVADVYVLAAGSFSATWAKHLGFDLPVRPAKGYSISVPMHRWERRPRVPIVDDSLHAALVPVGGVLRVAGTAEFAGYDTTVRPERIDNLRGLLRRVYPQFAESADSVDIQPWCGLRPLTPDGMPIVGRTPLENLYVNTGHGPLGWSMACGSGKAVADIAAGHAADLDMTPFALTRF

SEQ ID NO: 347 - DNA, 1245 bp, Unknown
  Obtained from environmental sample
atgcgtactgacgtagtcgtcctcggcgctggcattgtcggcatctgtgtcgcgctgcacctgcagaagcgcgggcgttcggtcgtgctggtcgaccggcggggcgcggccgaggagacctcgttcgggaacgccgggctgatccagcgcgagggggtctatccgtacggctttccgcacgacttcggcgcgttgctgcgctacggcctgaaccggaccatcgacgcctattaccacccgaccgcgctgccgagcctcgctccgttcctgctcaagtactggcgctactcgcgtcccgcccggcacgcgcaggtggcgcgctcctactcgaagctgatcgagcactgcgtgaccgagcacgaggcgctcgccgccgaggcgggcgcggacggcttcctgcaccgcaagggctggctgaaggtgttccgcaccgagcgcgagcgtgaccggcgcttcgccgaggccgagcgctggcgcgaggagttcggcatcaaccaccgcgccatcgaggcgcgccagctccaggagatggagccgcacgtggcgccggtcctggtgggcgcgctgcactggaccgatccggtcagcgtcgacgacccgcacggcctggcgctcgcctacctcgcgctgttcgagcgcctgggcgggaagttcgtgcagggcaacgcctccagcctggaatcccaggaagaaggctggcgcatgcgtacagtggaagggccgattgcgatgaaaggcgtagtggtggcgctcgggccctgggccgacgtgctcactaaagccctcggctatgacttcccgctcgcggtgaagcgcggctaccacatgcactaccgggcggccggaaccgcgaggctgaactacccgatgctcgacaccgagcgcggctacttcctcgcgcccatgcgccgcggcatccgcctcaccaccggcgcggagttcgcgctgcgcgacgcgatccgcacgccggtgcagctcggccgcgccgagccgatcgcgcgcgacctctttcccctcgccgagcgcctggacaccgaggcgtggatgggcgcgcggccctgcacgccggacatgctgccggtgatcggcgccgcgccgcgccaccgcaacctcttcttcgccttcggccacgcgcaccacggcctgacgctcggcgcggtgaccggaaggctggtcgcggagatgatgaccggcgaggcgccgctggtcgatcccgccccgtattctccggagcgcttcgcgtga

SEQ ID NO: 348 - protein, 414 aa, Unknown
  Obtained from environmental sample
  DOMAIN (4)...(395): FAD dependent oxidoreductase
  SITE (72)...(75): N-glycosylation site. Prosite id = PS00001
  SITE (225)...(228): N-glycosylation site. Prosite id = PS00001
MRTDVVVLGAGIVGICVALHLQKRGRSVVLVDRRGAAEETSFGNAGLIQREGVYPYGFPHDFGALLRYGLNRTIDAYYHPTALPSLAPFLLKYWRYSRPARHAQVARSYSKLIEHCVTEHEALAAEAGADGFLHRKGWLKVFRTERERDRRFAEAERWREEFGINHRAIEARQLQEMEPHVAPVLVGALHWTDPVSVDDPHGLALAYLALFERLGGKFVQGNASSLESQEEGWRMRTVEGPIAMKGVVVALGPWADVLTKALGYDFPLAVKRGYHMHYRAAGTARLNYPMLDTERGYFLAPMRRGIRLTTGAEFALRDAIRTPVQLGRAEPIARDLFPLAERLDTEAWMGARPCTPDMLPVIGAAPRHRNLFFAFGHAHHGLTLGAVTGRLVAEMMTGEAPLVDPAPYSPERFA

SEQ ID NO: 349 - DNA, 1251 bp, Unknown
  Obtained from environmental sample
gtgggtgtggcacgtactgatgtaatggttcttggtgccggcattgtcggcacatcggtggcgctgcatctcgcaaaacgcggactcagtgttgccttggtcgatcgcgcggggattggcgagcagacatcctatggcaacgccggtatcatcgaaggcaatacggtatttcctccagcgtttccttcgcattttgacgcgctgctgcgcgtcgcgcttaagcgtgccagcgaggccaactatcatttgtcattcttgccgcacgtcctgccatggttattggcgttccgcgccgcctcgcgaccggatcgccttgtggagacagcccggctgatccgccctttgttttctcatgcggtggccgagcacgaggcgctgatggccgagagcagcgctacccactacctgcgcaaaaccggctggctcaaagtttatcgtaacgaaaggagttttaaggggctggcggctgagttcgacctcgcggcgaaatttggcttgccgctgaatgcactcgacaccgagggagcacaggccctcgagccgtcactcaattcggtatttgccaaagcggtgttctggccagaagcggcgagcatcagcaatcccctcggcgtgaccaaagcctatgcgtcgcgctttgccgcgctgggaggtgtgctcgtggcgggggatgcgcgatcgctccaccggacgggtaatcgctggcgggtggacaccgcggaaggcgcgcttgatgcccaggagtgcgtggtcgcactcgggccttgggctacagacttgcttgatgcgctcggtctgcgattgccgctcgcagttaagcggggctaccaccggcactttcggtcccagggaaatgcgagcctgtcgcgtccggtgctcgacgccgacgtcggctatctgattaccccaatggagcaggggatgcgcataaccaccggtgcggagtttgcgccgcgcgatgcggctcccactccggtacagtttcttcgcatcatgccgcgggcgcgtgagctgtaccctttgggagagcaggtcgacgggcgaacatggctgggcagccggccgtgctttcccgattcccggcccgtcatcgatcgggcgcccggacacgccgggctgtggctcgccatcggtcacgcccactgggggctcacactcggccccgccaccggacgcatgattgcgcagatgatggccggtgagttgccgttttgcgatccggcgccttaccgcgcggagcgatttaactag

SEQ ID NO: 350 - protein, 416 aa, Unknown
  Obtained from environmental sample
  DOMAIN (7)...(397): FAD dependent oxidoreductase
  SITE (289)...(292): N-glycosylation site. Prosite id = PS00001
MGVARTDVMVLGAGIVGTSVALHLAKRGLSVALVDRAGIGEQTSYGNAGIIEGNTVFPPAFPSHFDALLRVALKRASEANYHLSFLPHVLPWLLAFRAASRPDRLVETARLIRPLFSHAVAEHEALMAESSATHYLRKTGWLKVYRNERSFKGLAAEFDLAAKFGLPLNALDTEGAQALEPSLNSVFAKAVFWPEAASISNPLGVTKAYASRFAALGGVLVAGDARSLHRTGNRWRVDTAEGALDAQECVVALGPWATDLLDALGLRLPLAVKRGYHRHFRSQGNASLSRPVLDADVGYLITPMEQGMRITTGAEFAPRDAAPTPVQFLRIMPRARELYPLGEQVDGRTWLGSRPCFPDSRPVIDRAPGHAGLWLAIGHAHWGLTLGPATGRMIAQMMAGELPFCDPAPYRAERFN

SEQ ID NO: 351 - DNA, 1260 bp, Unknown
  Obtained from environmental sample
atgtcttcgactgcgaagcctgacatcatcgttgttggatccggcatcatcggcattgcgtgcgcacattacctaagtgggtctggtctgcgagtgactgtgatcgatcaaggaacgatcggcggcgcgtgttcgcacggcaactgcggctacatctgtccgagtcatgtgttgcccctgacggaaccgggagcgatcggcactgcgctgaaatcactctttaatccgaaagctccatttcgagtgaagccccgactgagccccgccctggtgaagtggatgtggcaatttgccaggcgatgcaatcatcgtcaactgttggccgccgggcagcatctcaaagcgattctggattcttcgatgctggagtacaaacatctgatgcacgaagaaggcctgccgtgtgaatggaaagagatcggcctgttgtacgttctgcaaacggagcacggcatggaggacttcgcgaagaacgatcggctgctgactgagcatttcgggttatcggcacgaagaattgaaggacgcgatctggccgcgtttgatccagcattgcggcctggtctggccggagcctttcattacccgaacgacgcgacgattcgtcccgacttgctcaatgcgagttggtcgcagcggctcaaagaacgtggagtgaccttcatcgagcattgccagttgcagcgcgtcgagaagtcgaaaggccgggttgttcaactcgccacttcgcaagggacattgcaagcggaacgcatcgtgatcgcgaccggagcatggagttcaaaactctcatccgatctggaatgcccgatcccgatcgagcccggcaaaggatactcagtaacgatgcaacggcccgatccatgcccacgcaatccgatgctgtttcccgagcatcgcgtcgcagtttcaccttttgagcacggttatcgcctcggctcaatgatggagttcgcaggcttcgacgaatccattcccgcacggcgcatccaacagttgcaggactcggcatcgcattacctcgcttcatcaacaccgcccggtgagcttcagagctggtacggctggcgcccaatgacctgggatagtttgcccattatcggccgaaccccgcgactcgagaacgtctacctcgcgaccggccacaacatgctgggcatgagcctcgcaacggcgtcgggcaaactggtcgccgagctgatatccggccgcacgccgcatctcgatcccgccgcattctcgccgcagcgatttctttag

SEQ ID NO: 352 - protein, 419 aa, Unknown
  Obtained from environmental sample
  DOMAIN (8)...(400): FAD dependent oxidoreductase
  SITE (210)...(213): N-glycosylation site. Prosite id = PS00001
MSSTAKPDIIVVGSGIIGIACAHYLSGSGLRVTVIDQGTIGGACSHGNCGYICPSHVLPLTEPGAIGTALKSLFNPKAPFRVKPRLSPALVKWMWQFARRCNHRQLLAAGQHLKAILDSSMLEYKHLMHEEGLPCEWKEIGLLYVLQTEHGMEDFAKNDRLLTEHFGLSARRIEGRDLAAFDPALRPGLAGAFHYPNDATIRPDLLNASWSQRLKERGVTFIEHCQLQRVEKSKGRVVQLATSQGTLQAERIVIATGAWSSKLSSDLECPIPIEPGKGYSVTMQRPDPCPRNPMLFPEHRVAVSPFEHGYRLGSMMEFAGFDESIPARRIQQLQDSASHYLASSTPPGELQSWYGWRPMTWDSLPIIGRTPRLENVYLATGHNMLGMSLATASGKLVAELISGRTPHLDPAAFSPQRFL

SEQ ID NO: 353 - DNA, 1263 bp, Unknown
  Obtained from environmental sample
atgcgccaatcccgttcggtcatcatctgcggcggcggcgtcatcggcctgagctgtgcctattacctggcccgcgagggctggcgggtcacgctcgtggagcgcaacgccgagggcgccgactcctgcgcgcacggcagcgccggctatgtctcgccgagccacgtggagccaatctcggcgcctggcatggtgtggaaggggctcaagtggatgatgagttcgcggagcccgttttatatcaagccgcgactcgacagcgacctgatccgctggggctggctcttcgcccggcattgcaccgagcaacaccggcgccggtccgccccggtgttgcgcgacctgtgcctcggtgggcggaagcttttcctggaactgtcggacatcaccggcgattccttcgagctgaagcaggaggggctgatgaacctctgccagacccaggagacgctcgacaaatacacccacggtctcgccgcgctgtgcaacgaggtcggcgtcgaggcgcgcacgctgaacgcgcagcaggcgcaggcgctcgagccgggcgtgaagatgaaggtggccggggcgatttatttccccatcgatgcacacctctcgccgcggctgttcgtcccggcgctgaccgcgctgctcaaggacatgggcgtgaagttctgctggaacacgagtgtctatggctggcgctccgagggcggccgcgtcacggccgtgtccacgacggccggtgacctcatcgccgacgaatacgtgctggccggcggctcctggtcgccgtcgatggtccacggcctgggcatcaggcttccgatgcaggcgggcaagggttacagcctgacgatggaccggccgcggtttcacctgaccaaaccgatgatcctgacggagcgccgcgtggcggcgacaccgatgggggacaaactgcgctttggcggcacgatggagatcgccggccacagcgacaacgtcaggcctgagcgcgtccagcagatcaaggacggcgcgcgcgccttcttccccgagatcaccgaggcggatttcgacggcatcaagccgtggttcggctaccggccggtctcgcccgacggcatgccctacatcgggcggctggggcgttatgcgaatctttccaccgccagcgggcacgcgatgctcgggttgacgctggcgccgatctcaggcttgctcattgccgaggtgctgacgggcaagaagccatcggtggacctttcgctgctcaatcccaaccgcttcgcgtga

SEQ ID NO: 354 - protein, 420 aa, Unknown
  Obtained from environmental sample
  SIGNAL (1)...(24)
  DOMAIN (6)...(401): FAD dependent oxidoreductase
  SITE (226)...(229): N-glycosylation site. Prosite id = PS00001
  SITE (381)...(384): N-glycosylation site. Prosite id = PS00001
MRQSRSVIICGGGVIGLSCAYYLAREGWRVTLVERNAEGADSCAHGSAGYVSPSHVEPISAPGMVWKGLKWMMSSRSPFYIKPRLDSDLIRWGWLFARHCTEQHRRRSAPVLRDLCLGGRKLFLELSDITGDSFELKQEGLMNLCQTQETLDKYTHGLAALCNEVGVEARTLNAQQAQALEPGVKMKVAGAIYFPIDAHLSPRLFVPALTALLKDMGVKFCWNTSVYGWRSEGGRVTAVSTTAGDLIADEYVLAGGSWSPSMVHGLGIRLPMQAGKGYSLTMDRPRFHLTKPMILTERRVAATPMGDKLRFGGTMEIAGHSDNVRPERVQQIKDGARAFFPEITEADFDGIKPWFGYRPVSPDGMPYIGRLGRYANLSTASGHAMLGLTLAPISGLLIAEVLTGKKPSVDLSLLNPNRFA

SEQ ID NO: 355 - DNA, 1017 bp, Unknown
  Obtained from environmental sample
atgaaacccgacggcggctccctcatcggcttcggttccagcggcctcggcggcgccactttcaaggcgttcgatcccgcaaaaaatgtcgccctcgagccgacctttctctcggccgtcaccgaggacgtcgagcgcgccgtccagctggccgtcgccgccgcgccggtctgggccaagctgtcgggaacggagcggaacaagtttctcatttcgatcgcggacaagcttgaggccaagtcggccgacctcgtggcccgggccatgcaggagaccggcctgcccgaggcgcgcctcaagggcgaggtgacccgcaccgcgggccagctgaaactttacggcgagacggcgcagcgcggcgactggctcgatgcccgcatcgagacggcgttgcccgaccgcaagccactgcccaagcccgaccaccgttcgatgctccgcgcgatcggcccggtggtcgtgttcggctcgagtaattttcccttcgcctactcggtggcgggcggcgacgtggcctcggccttcgcggccggttgcccggtcattgtcaaggcccacccggcgcatcccggcacgagtgagatggtcggccggctgatcctccacgccgtgcgcgagtgtggcctgcccgaaggcacgttctcgctgttattcgacgccggctttgaggtcggccaggcgctggtgcagcaccctgaggtgaaggccgtgggtttcacgggctcggtcaagggtgggcgggcgctcaccgatctcgccgcggcccggcccgagccgattccggtctatgccgagatgggcagcgtcaaccccgtcttcatcctgcccggcgccatcgccgagcgtgcagcgggcatggtcgagggcctgtatgcctcgtccaccgttggtgtcggccagttctgcaccaatcccggcctgatcgtgctgcagcgttcggcggcggcggagcagttcatcaaggacatggccgcccgcctcagcgcgacgctcgagggcgtgatgctcacgcccggg

SEQ ID NO: 356 - protein, 339 aa, Unknown
  Obtained from environmental sample
  DOMAIN (11)...(339): Aldehyde dehydrogenase family
MKPDGGSLIGFGSSGLGGATFKAFDPAKNVALEPTFLSAVTEDVERAVQLAVAAAPVWAKLSGTERNKFLISIADKLEAKSADLVARAMQETGLPEARLKGEVTRTAGQLKLYGETAQRGDWLDARIETALPDRKPLPKPDHRSMLRAIGPVVVFGSSNFPFAYSVAGGDVASAFAAGCPVIVKAHPAHPGTSEMVGRLILHAVRECGLPEGTFSLLFDAGFEVGQALVQHPEVKAVGFTGSVKGGRALTDLAAARPEPIPVYAEMGSVNPVFILPGAIAERAAGMVEGLYASSTVGVGQFCTNPGLIVLQRSAAAEQFIKDMAARLSATLEGVMLTPG

SEQ ID NO: 357 - DNA, 1251 bp, Unknown
  Obtained from environmental sample
atgaaaaatgtaatagtagtaggaggcggtataatcggtttaagcagtgctttgtatttgcaacgttcggggcataacgttactgttattgataaagataattttacagataactgttcgtatggtaatcttggttatgtatgcccgagccattttatacccttggcagcaccgggtattgtgtggcagggaattaaatggatgttcaacagccgcagccctttttatgtgcaaccatcgttgaatctctctttaatagactggggattaaagttcatgcgcagcgccactcaaaaaaatgttgatgaagcggctactccattaaaggatatagctgtatttagtcaacaggaatataaggagtgggaaaaaatggaaggctttgagttcgcttatgaacataagggtatgctggaaattttcaaaacggagaaggtcgcacatcatgcagcgcatacagttgaaacgggaaaaaaacttgggttagatgttgagctgctagatgcaaaaggcttacagcaactggaaccgcaaacaaccatcaatgcattaggcgctattaactttaagtgtgatgcacatttatatcctgataaattaatggcctcattaaaaaaatatttgccgcaaaagggtgtgcaattaatacatgatgaagtaacaggatttgaaaaaagcagcaacaagataactaaagtgctttgtaagagtaataattacaatacagatgaagttgttgtcgctacgggttcatggagccgggaagtagctgctatgcttgataccaaaattccattgatgcccgggcgtggttattccttcacgttagataatccagaatataaattgaaccatccggcaattcttgccgaaggaagagttgctattacaccatttgagaatggcaataaaatgcgttatggcggtactatggaagtagtgaacacaaaagcgccgccacgctatcatcgcgtagaaggcattataaatgctgttaaagattttttacctgactttaaacttgaaatgcctgcacaggataaaatatggtatggttacaggcccacatctgcagacggattgccctacatcggccgtgtacagaaatataaaaatgtaactgtagcaacaggccatgcgatgttaggattgagtttgggcgcaggcaccggcaaattagtaagtgaactgattaatgaaacaaaaccaggcgtagagctaaaagcttttgatgtagaaaggtttggatag

SEQ ID NO: 358 - protein, 416 aa, Unknown
  Obtained from environmental sample
  DOMAIN (3)...(397): FAD dependent oxidoreductase
  SITE (26)...(29): N-glycosylation site. Prosite id = PS00001
  SITE (34)...(37): N-glycosylation site. Prosite id = PS00001
  SITE (38)...(41): N-glycosylation site. Prosite id = PS00001
  SITE (83)...(86): N-glycosylation site. Prosite id = PS00001
  SITE (377)...(380): N-glycosylation site. Prosite id = PS00001
  SITE (405)...(408): N-glycosylation site. Prosite id = PS00001
MKNVIVVGGGIIGLSSALYLQRSGHNVTVIDKDNFTDNCSYGNLGYVCPSHFIPLAAPGIVWQGIKWMFNSRSPFYVQPSLNLSLIDWGLKFMRSATQKNVDEAATPLKDIAVFSQQEYKEWEKMEGFEFAYEHKGMLEIFKTEKVAHHAAHTVETGKKLGLDVELLDAKGLQQLEPQTTINALGAINFKCDAHLYPDKLMASLKKYLPQKGVQLIHDEVTGFEKSSNKITKVLCKSNNYNTDEVVVATGSWSREVAAMLDTKIPLMPGRGYSFTLDNPEYKLNHPAILAEGRVAITPFENGNKMRYGGTMEVVNTKAPPRYHRVEGIINAVKDFLPDFKLEMPAQDKIWYGYRPTSADGLPYIGRVQKYKNVTVATGHAMLGLSLGAGTGKLVSELINETKPGVELKAFDVERFG

SEQ ID NO: 359 - DNA, 1251 bp, Rhodococcus ruber DSMZ 44319
atgtcggttcgtcggacggtggtcgtcggtgcggggatcgtgggcctgtccactgcgtggttcctgcaggaacgcggtatcgaggtcacggtgctcgatcgggtcggtgtggcgggcgacgcatcgtggggcaacgccgggtggctcgcgccggcgctgaccctgccgctgcccgagccgggggtgctgcgctacgggttgcgctcgatgttccggccgtcctcgccggtgtacgtgccgcccacgacggatctgcggttgctgcgcttcctcgccgacttcgcgcggcactgcacgagacggaaatggacgtcgtcgatggaggtcttcgcgcgcgccaaccgcgtcgccctcgacgcctacgacgatctcgcccgcgggtcgggcgacacgatcgtcaccgagccgacgcgggtcgccgatccgttcctcgcggcgttcacctcggacgacgatcgacggctgctggtcgaggagttcgagcacgcacgtgccgcaggcagcgagatcgatttcgacctgctcgacaccgacacgctgcattcgctcgaaccgctgctcggggacccggtgcgggtcgggctccggatccgggggcagcggttcatcgatccgccgcggttcgtcgcctctctggcgcacgcggtccgcgcccggggcgcggagatcgtcaccgatgtcgacgtccaggaggtgcgcgacaccggtcgcggggtggacgtcgtcgtggccggtggcgactcccgttcggcggatgcggtggtgctcgcgaacggagcgtggctcgggccgctcgcccggccgttcggtgtgcgcacgcaggttcaggccggtcgcggctacagcttcagcgtgcggccgccgagcctgccgaagaacccggtctacttccccgcccagcgggtggcgtgcacacccctccaggaccgcttccgggtcgccggcatgatggagttccgcagccccgacgccccgctcgacccgcggcgcatcgaggcgatcgtcgacgcgacccgaccgctgctgcgcgatgtcgactgggacgggcgcagcgaggagtgggtgggctcgcgtccgtgcacggcggacgggctcccgctgatcggccgcacgcgttcggagcgggtgtacgtcgccggcgggcacgggatgtggggtgtggcgctcggtcccctcaccggacggctgctcgccgggtcgatgaccggcgagccggatccgttgctcaggtcgttcgatccgctgcgctga

SEQ ID NO: 360 - protein, 416 aa, Rhodococcus ruber DSMZ 44319
  DOMAIN (5)...(400): FAD dependent oxidoreductase
MSVRRTVVVGAGIVGLSTAWFLQERGIEVTVLDRVGVAGDASWGNAGWLAPALTLPLPEPGVLRYGLRSMFRPSSPVYVPPTTDLRLLRFLADFARHCTRRKWTSSMEVFARANRVALDAYDDLARGSGDTIVTEPTRVADPFLAAFTSDDDRRLLVEEFEHARAAGSEIDFDLLDTDTLHSLEPLLGDPVRVGLRIRGQRFIDPPRFVASLAHAVRARGAEIVTDVDVQEVRDTGRGVDVVVAGGDSRSADAVVLANGAWLGPLARPFGVRTQVQAGRGYSFSVRPPSLPKNPVYFPAQRVACTPLQDRFRVAGMMEFRSPDAPLDPRRIEAIVDATRPLLRDVDWDGRSEEWVGSRPCTADGLPLIGRTRSERVYVAGGHGMWGVALGPLTGRLLAGSMTGEPDPLLRSFDPLR

SEQ ID NO: 361 - DNA, 1251 bp, Rhodococcus ruber DSMZ 44319; identical to SEQ ID NO: 359

SEQ ID NO: 362 - protein, 416 aa, Rhodococcus ruber DSMZ 44319; identical to SEQ ID NO: 360
  DOMAIN (5)...(400): FAD dependent oxidoreductase

SEQ ID NO: 363 - DNA, 1251 bp, Rhodococcus ruber DSMZ 44319; identical to SEQ ID NO: 359

SEQ ID NO: 364 - protein, 416 aa, Rhodococcus ruber DSMZ 44319; identical to SEQ ID NO: 360
  DOMAIN (5)...(400): FAD dependent oxidoreductase

SEQ ID NO: 365 - DNA, 1266 bp, Unknown
  Obtained from environmental sample
gtgaaagttctgatcctcggcagcggtgtcatcggcgtcacctccgcctactacctcgcccgtgccggccatgaggtgacggtggtcgaccgtcagccggagccggcactggagacctctttcgccaatgccggcgaggtatcgcccggctattcctcgccatgggccggccccggcgtgccggtgaaggcggtcaaatggctgttgatgaagcacggcccgctggtgatccggccgaagctcgatccggtgatgtgggtctggctgctgaagttgctgcgcaactgcaccagcgcgcgctacgcggtcaacaagagccggatgattccgatcgcggaatacagccgcgatgccttgcgcgatctgcgccggcagatcggcatccaatatgacgagcgctcgcagggcaccctgcagctgtttcgctaccaggcccagctcgatggcaccgccgaagatatcgccgtgctcaagcaatacggcgttcccttcgaggtgctgagccgcgagggctgcatcgccgtcgagccggcgctatcaggcgtgaaggagaagttcgtcggcgggctccgcctgccgcaggacgagaccggcgattgccacatgttcacgcagtcgctggccaagcatgcccaggcgctcggcgtccgcttcatgttcaacacctcgatcgatcgcatcgtcaacgagggcgcgcgcgtcagcggcgtcgcgaccagcgccggcctgttgcaggcggacgcttacgtgctggcgctcggcagctggtcgtcgcggctggcggcgccgctcggcatttcgctgccggtctatccggtgaagggctattcgatcacggtgccgatcaaggacgcttccggcgcgccggaatcgaccgtgatggacgagagctacaaggtcgcgatcacccggctcggccatcgcatccgggtcggcggcaccgcggaaatctccggctattcggacaagctctacgatgcgcgccgcgccacgctcgatcattcgctgaccgacctgttcccgcgcggcggcgatctcggcaaggcgacgttctggagcggcctgcgcccgatgacgccggacggcccgcccgtgatcggcccgacgcaatatgccaacctccacctcaacaccggccacggcacgctgggctggaccatgtcctgcggctcgggccgcgtgctcgccgacatgctgtcgggcaggaagccggagatcgacgtgagtgcgctgtcggtggagcgatacaagcaccggttcggctaa

SEQ ID NO: 366 - protein, 421 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
  SITE (224)...(227): N-glycosylation site. Prosite id = PS00001
MKVLILGSGVIGVTSAYYLARAGHEVTVVDRQPEPALETSFANAGEVSPGYSSPWAGPGVPVKAVKWLLMKHGPLVIRPKLDPVMWVWLLKLLRNCTSARYAVNKSRMIPIAEYSRDALRDLRRQIGIQYDERSQGTLQLFRYQAQLDGTAEDIAVLKQYGVPFEVLSREGCIAVEPALSGVKEKFVGGLRLPQDETGDCHMFTQSLAKHAQALGVRFMFNTSIDRIVNEGARVSGVATSAGLLQADAYVLALGSWSSRLAAPLGISLPVYPVKGYSITVPIKDASGAPESTVMDESYKVAITRLGHRIRVGGTAEISGYSDKLYDARRATLDHSLTDLFPRGGDLGKATFWSGLRPMTPDGPPVIGPTQYANLHLNTGHGTLGWTMSCGSGRVLADMLSGRKPEIDVSALSVERYKHRFG

SEQ ID NO: 367 - DNA, 1317 bp, Unknown
  Obtained from environmental sample
atgaaggtcatagtattgggttcgggcatcatcggcaccgcctccgcctggtttctgaacaaggcgggacacgaggtgactgtcgttgaccgtcagccaggcgcagcgcaggaaaccagctttgccaacggctgccagatttcggtatcgcatgccgagccctggtccaatccatcggcgcctttcaagattctcaagtggctcggcaaggaagatgcgcccctgctgtatcgcttccgggcggaatggctgcaatggaaatggggcctgaactttctgcgcgaatgcacggcctcgcgcaccgcctacaatatccgccagatcgtcgccatcgccgaatacagccgccagacgctgcaagccgtgcgcgccgaaaccgggctggactatgatcatctcacgcgcggcatcctccatttctataccagccagaaggatttcgatgcgtcgctgtcggccgccgctctgatgcgcgagctgggctgcccgcgcgaaaccatcagcgccgacgaggtggtccgcatcgaaccggcgttggccaaggtccgcgacaagatcgtgggcggcgacttcaccgcgaccgatgaatcgggcgatgtttacaaattcacgaccgggcttgccgccaaggctaaagaagccggcgtggatttccggttcgataccatggttacgcgcctgttggccgaaggcgccggcgcatccgcaaaaatcacgggcgtggaagtcatcgatgcacatggccgccatcaggcgctgcacgccgatgcattcgtgctggccatgggaagcttttcagcacctgtcgccaagccgctgggcatcgacctgctgatctatcccggaaagggctattccgccacctatcgggtcattgatcctggcgcggcgccgacggtatcgctgaccgatgatggctacaaactggtggtctcccgtctgggcgaccgcctgcgcgtggcgggaacctgcgaactcaacggctataccagggaactgaaccccattcgctgcgaggcgatcacccgccgcatccgcgaactgtttcccggcgcctgcgactacgataatccggcatattggaccgggttgcgcccgctgacgccatcgaacgtgccgtacatcggcaagaccaggtacggtaatcttttcctcaataccggacatggcacccttggctggaccatgggctgcggctccgggcgcgcaatcgctgaaatcgtgtccggcaagaccccggaagtcgatttcgacttcaccggcatgccgcgccgcccttcccggccgcttacggtttcccgtcctgcccaggcttga

SEQ ID NO: 368 - protein, 438 aa, Unknown
  Obtained from environmental sample
  DOMAIN (2)...(407): FAD dependent oxidoreductase
MKVIVLGSGIIGTASAWFLNKAGHEVTVVDRQPGAAQETSFANGCQISVSHAEPWSNPSAPFKILKWLGKEDAPLLYRFRAEWLQWKWGLNFLRECTASRTAYNIRQIVAIAEYSRQTLQAVRAETGLDYDHLTRGILHFYTSQKDFDASLSAAALMRELGCPRETISADEVVRIEPALAKVRDKIVGGDFTATDESGDVYKFTTGLAAKAKEAGVDFRFDTMVTRLLAEGAGASAKITGVEVIDAHGRHQALHADAFVLAMGSFSAPVAKPLGIDLLIYPGKGYSATYRVIDPGAAPTVSLTDDGYKLVVSRLGDRLRVAGTCELNGYTRELNPIRCEAITRRIRELFPGACDYDNPAYWTGLRPLTPSNVPYIGKTRYGNLFLNTGHGTLGWTMGCGSGRAIAEIVSGKTPEVDFDFTGMPRRPSRPLTVSRPAQA

SEQ ID NO: 369 - DNA, 1245 bp, Unknown
  Obtained from environmental sample
atgaaagtaacgatcataggaggcggcgtagttggtttatgttccgcttattatttaaataaagaaggatacgcggtcaccgttattgatcgcaacgatattaccgatggctgctcgttcggaaacatgggttatatttctcccagccattttattccgttagcatcgcctggcattattagccagggattgaaatggatgctcagctcatcttctccattttatatcaagccaagattaaattgggatcttattcaatggggtctttcgttctggaaaaattctactgagcaaaaagtaaaagaaaatgttccgcctctcaataatttattacagctgagccgtgaattaatgaatgatctgaaaaaagatttcaatgattccttcaccatgatcgaaaaaggttgctggacgctttataaaacacaaaagacggctgatcatgaaaaacatttaacagagcaagcggtaggacttgggttgaaaacaaaaatttgcaccagtgcagaggttcaacagatggagccggaggtggaaacagacgtgatcggaggtgtgctgtggttagatgattgccatttggacacgaggaaatttatgagaacattacatgaacaattagaaaaggcaggagtgaagtttttattgaatacagaagtaaaagggtttgaaagaaccaatggaaacattaatgcagtaattaccaacaaagaaaaaatcgatgcggatgaaattattgttgccaatggttcatggatgcctgaagtagcaaagatggcgggtgttcatttactaatgcaaccgggaaagggttatagtgtggtatatgagaatatggcaaagaatcttcatcatcccgctattttggttgaaggtagaacagcgatgacgcctattggtagatggttaaggatcggaggaactatggagttaagcggacatagtgataatgtcttgccgaagagagtatcggctatttataatgcggtaaaaaaatattttccctcaataaatattccggagccgcaatttgaaaaggcctggtatggttatcgccccgtaacacctgatggacttccttacattgggaagcataaaaaactttccaatataatatttgcaggagggcatgccatgttgggtgtatcagcagctgctgcaactggtaaaattgtaaatgagatcgtaagcaaccggccgacttctattgatgtttctgcatttagaccggaaaggttttcataa

SEQ ID NO: 370 - protein, 414 aa, Unknown
  Obtained from environmental sample
  DOMAIN (2)...(395): FAD dependent oxidoreductase
  SITE (95)...(98): N-glycosylation site. Prosite id = PS00001
  SITE (127)...(130): N-glycosylation site. Prosite id = PS00001
  SITE (252)...(255): N-glycosylation site. Prosite id = PS00001
MKVTIIGGGVVGLCSAYYLNKEGYAVTVIDRNDITDGCSFGNMGYISPSHFIPLASPGIISQGLKWMLSSSSPFYIKPRLNWDLIQWGLSFWKNSTEQKVKENVPPLNNLLQLSRELMNDLKKDFNDSFTMIEKGCWTLYKTQKTADHEKHLTEQAVGLGLKTKICTSAEVQQMEPEVETDVIGGVLWLDDCHLDTRKFMRTLHEQLEKAGVKFLLNTEVKGFERTNGNINAVITNKEKIDADEIIVANGSWMPEVAKMAGVHLLMQPGKGYSVVYENMAKNLHHPAILVEGRTAMTPIGRWLRIGGTMELSGHSDNVLPKRVSAIYNAVKKYFPSINIPEPQFEKAWYGYRPVTPDGLPYIGKHKKLSNIIFAGGHAMLGVSAAAATGKIVNEIVSNRPTSIDVSAFRPERFS

SEQ ID NO: 371 - DNA, 1266 bp, Unknown
  Obtained from environmental sample
gtgaaagttctgatcctcggcagcggtgtcatcggtgtcacctctgcctactacctcgcacgtgctggtcatgaggtgacggttgtcgaccgtcagcccgagccggcgctggagacctctttcgccaatgccggcgaagtctcgcctggctattcctcgccctgggccggccccggcgtaccggtgaaggcggtgaagtggctgctgatgaagcacggtccgctggtgatccggccgaagctagatcctgagatgtgggtctggctgttcaagatgctgcgcaactgcaccagcgcgcgctacgccatcaacaagagccggatgatcccgatcgcggaatacagccgcgatgtcttgcgcgatctgcgccgcgacatcggcattcaatatgacgagcgctcgcaaggaacgctgcagctgttccgttaccaggcccagctcgacggcacggccgaggacatcgccgtgctgaagcaatatggcgtgcccttcgaggtgctgagccgggagggctgcatcgcggccgagccggcgcttgccggcgtgaaggagaagttcgtcggtggacttcgcttgccgcaggacgagaccggcgactgccacatgttcacgcaggcgctggccaagcacgcccaggcgctcggcgtccgcttcatgttcaacaccggcatcgaccgcatcgccaccgacggcgcgcgtgtcagcggtgtcgcgaccagcgccgggatgttgcgggcggacgcgtatgtcctcgcgctcggcagctggtcgtcgcggctggttgcgccgctcgggatctcgttgccggtctatccggtgaagggctattcgatcacggtgccgatcaaggacgcctccggcgcgccggaatcgaccgtaatggacgaaagctacaaggtcgccatcacgcgattgggcgatcgcatccgcgtcggcggcaccgcggaaatctccggctattccgacaagctctacgatgcccgccgcgccacgctcgatcattcgctgaccgacctattcccgcgcggcggcgatcttgccaaggcgacgttctggagcggcctgcgcccgatgacgccggacggcccgccggtgatcggcccgacccaatacgccaatctccacctcaacaccggccacggcacgctcggttggaccatgtcctgcggctccggccgcgtgctcgccgacatgctgtcgggcaagaagccggacatcgacgtcggtgcgctgacggtagatcggtacaagcaccggttcgggtga

SEQ ID NO: 372 - protein, 421 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
MKVLILGSGVIGVTSAYYLARAGHEVTVVDRQPEPALETSFANAGEVSPGYSSPWAGPGVPVKAVKWLLMKHGPLVIRPKLDPEMWVWLFKMLRNCTSARYAINKSRMIPIAEYSRDVLRDLRRDIGIQYDERSQGTLQLFRYQAQLDGTAEDIAVLKQYGVPFEVLSREGCIAAEPALAGVKEKFVGGLRLPQDETGDCHMFTQALAKHAQALGVRFMFNTGIDRIATDGARVSGVATSAGMLRADAYVLALGSWSSRLVAPLGISLPVYPVKGYSITVPIKDASGAPESTVMDESYKVAITRLGDRIRVGGTAEISGYSDKLYDARRATLDHSLTDLFPRGGDLAKATFWSGLRPMTPDGPPVIGPTQYANLHLNTGHGTLGWTMSCGSGRVLADMLSGKKPDIDVGALTVDRYKHRFG

SEQ ID NO: 373 - DNA, 1260 bp, Unknown
  Obtained from environmental sample
atgaagccggacgtgatcgtactcggtgccggaatggtcggcgtctcgacggctctccatctccagagccgcggccatgacgtggttctggtcgaccgccgtcctcccggcgaggaaacctcgttcggcaatgccggcgtcatccagcgcgaggccgtggaaccctacgcctttccccggtccgccctgcagctcctgcgtttcgcgtgcaagaccggcccggaggtgaactatcattttcgtgcgctgcccggtctgataggaccgcttctgcggtactggtggttttccgcgcccgcccgctaccccgccattgccgccgcgcatgcaaggctgatagagcactgcctcagcgagcacgaggtgctgatcgggcaggccgcggcggacgatctggtgcggcgcgacggtttccgctttgtctacaggtccgcaagggccctggagaccgacgcggcgcaggcccggcaactggcggccgaccatggccttgcctgcgattttcttgacggcgatgccctggcacgggccgagccggcgctgaaacagccgctggctggcgcgcttcactggcgcgatccctggacggtcagctcgccgggagagcttgtcctccgctatgccgcgctgttccggcggaagggtgggactgtgctgaccggcgatgcggcaagcctgacccggaagggaaattccggctgggcggtgatgacggaggacggcaagctggaagccgccaatgcggtgatcgcgcttggcccctggtcggtggagaccgcaaggcgcctcggataccgactgcctctgttcgtcaagcgcggctatcatcgccactaccggcccccggatggcgccgcgcggctggcactgccgatgctggatgcgcagaagggggtcgtgctggcgcccatggcacaggggctgcggattaccaccggcgccgaattcgcccggctcgaagcgccatcgacgccagtacagatcgaaggtgctgcccgggcggcggccgagttgctggatgtcggcacgccggtcgagccggcaccgtggcgtggcgcacggccatgcaccccggacatgctgccggtggtcggtgccgcgccgcgccacaacggcctgtggttccatttcggtcatgcccatcagggcttcacgctcggccccgtcaccggcaggctcattgcggagatgatcgggggcgagcgccccttcctcgacccgtcaccttatgccgtcacccgctttgccggcgggcgctga

SEQ ID NO: 374 - protein, 419 aa, Unknown
  Obtained from environmental sample
  DOMAIN (4)...(397): FAD dependent oxidoreductase
MKPDVIVLGAGMVGVSTALHLQSRGHDVVLVDRRPPGEETSFGNAGVIQREAVEPYAFPRSALQLLRFACKTGPEVNYHFRALPGLIGPLLRYWWFSAPARYPAIAAAHARLIEHCLSEHEVLIGQAAADDLVRRDGFRFVYRSARALETDAAQARQLAADHGLACDFLDGDALARAEPALKQPLAGALHWRDPWTVSSPGELVLRYAALFRRKGGTVLTGDAASLTRKGNSGWAVMTEDGKLEAANAVIALGPWSVETARRLGYRLPLFVKRGYHRHYRPPDGAARLALPMLDAQKGVVLAPMAQGLRITTGAEFARLEAPSTPVQIEGAARAAAELLDVGTPVEPAPWRGARPCTPDMLPVVGAAPRHNGLWFHFGHAHQGFTLGPVTGRLIAEMIGGERPFLDPSPYAVTRFAGGR

SEQ ID NO: 375 - DNA, 1257 bp, Unknown
  Obtained from environmental sample
atgggtaaacaggttttaattattggcggcggtatcatcggcctcagcagcgctttttatttgcggcaggaaggctttgaggtgaccgtggttgaccagggcgatcttaccaatggctgctcttacggcaacgcaggatacttatgtcccagtcattttgtgcccatggccgcccccggcatcgtggcgcagggattcaaatggatgttcaattcaaaaagcccgttttatgtgcagccccgtttaaacagcgaactgatcagctggggtttgcaattcatgcgcagcgccaataaaacgcatgttgacaattcggctgttcctttacgtgatatcgctttgttgagtaaaggattatatgaagaatggacgaagctgcccgggttcaattttgcctacgatccgagaggcttgctcgacctttttaaaacagaagccaatgcgcatcatggcgagcacgcggtaaaagatgcccgcgcattaggtctcgatgcccgtttgctgaacaagcaggaagtagccgccatgtttcccggcgttcaactcgatattttaggtgccgtttattatggctgcgatgcgcagttgtatcctaacaagctcatggccgacctggtgaattatttaaagcaaaacggtgtacagtttgaattgaataaaactataaccgggtttaccatcgatggctctaccgtagctgcggttcacgctgaagggaaaattttcaaacccgatcatatcgtattagccgccggtgtgtggagcggctccatagccaaacaactgaacatcaaaatacccatggtgggcggcaggggttactcggtgaccttcgaaaatgcgccctggaaatttacctatcccgtgttgctgagcgaggcgcgtgtggccatttccccaatggatggcaataaactccgctttggcggcaccatggaaattaccggcactaaaacacctccacgcctcaatcgtgtgagaggcatactggaagccgtaacaagatatttccccgactataaagtgccgatgccgcctgaaaattcgatctggtatggataccgtccctgcagtgcagatggattgccgtatattggtaatatcagtcgctataaaaaccttacggtgggcaccggccactcgatgctgggactgagcctgggcgcaggaaccggcaaactcgtgagcgaactggtggccggcaaaaaaacagctatggacaccacgccattccgggtagaaagattcgatcgatga

SEQ ID NO: 376 - protein, 418 aa, Unknown
  Obtained from environmental sample
  DOMAIN (4)...(398): FAD dependent oxidoreductase
  SITE (99)...(102): N-glycosylation site. Prosite id = PS00001
  SITE (222)...(225): N-glycosylation site. Prosite id = PS00001
  SITE (372)...(375): N-glycosylation site. Prosite id = PS00001
  SITE (378)...(381): N-glycosylation site. Prosite id = PS00001
MGKQVLIIGGGIIGLSSAFYLRQEGFEVTVVDQGDLTNGCSYGNAGYLCPSHFVPMAAPGIVAQGFKWMFNSKSPFYVQPRLNSELISWGLQFMRSANKTHVDNSAVPLRDIALLSKGLYEEWTKLPGFNFAYDPRGLLDLFKTEANAHHGEHAVKDARALGLDARLLNKQEVAAMFPGVQLDILGAVYYGCDAQLYPNKLMADLVNYLKQNGVQFELNKTITGFTIDGSTVAAVHAEGKIFKPDHIVLAAGVWSGSIAKQLNIKIPMVGGRGYSVTFENAPWKFTYPVLLSEARVAISPMDGNKLRFGGTMEITGTKTPPRLNRVRGILEAVTRYFPDYKVPMPPENSIWYGYRPCSADGLPYIGNISRYKNLTVGTGHSMLGLSLGAGTGKLVSELVAGKKTAMDTTPFRVERFDR

SEQ ID NO: 377 - DNA, 1245 bp, Unknown
  Obtained from environmental sample
atgagtaagaaggtagttgtcattggatctggaatagtaggggcctcgtgcgcttactatttacacaaagccgggcacgaggtggtgcttctggaaaaggagcaacagggctctggggcttcctatgtcaatgcgggctatataactcccagccatattattccactggctgcaccggggatggtccaaatggggatgaagtacttattcgattccagtggtcctttttatatgaaaccccggttcgatttagactttataaagtgggcttgggcctttcaaaaatcctgcaccaaaagcaatgtacaaaaggccattcctttgatcaaggccctgaacattcacagccgggaattgtatgaagagttgttgagttgtggtgatctcggagaattccactgggaggataaaggtcttttgatggtctacaaaacacaaaaggccgccgattccgaaggacttgtggctgaagaggcgcgaagcttgggactggaagtagatcaactggacaccaatcgcctgcgcgaattggaacccggttttggagaggaagttttgggcgcttggcattaccattgcgatcgacacagcacaccaaccgatgtgcttcctcggcttttgaagtatctgcggcaacacattagttttcagaaatcgaagggcgttgatcatatcaaaagcacttcgcttggggtaagcttaaaatgtggccaagaaagccttacggctgatcgcgttgttattgcagctggcgtctggtcttcccaattagcaaaacagttgggacagcgtttgcatttggaagcgggaaaagggtaccgaatcgatgtggagaacgaattgaatattgggatgcccgctatttccttggagcacaaaattgctgttacccctatgaaaggatttacccgattcgcaggaaccatggagttttcgggaatcaacaccaccgttcgtcctgaaagggttgccgctattgccaaagcggcgcaatccctatatgccaatttggatttttcggaacaagacctggcctccgctgcaacaggaatgcggcccgtaagcccggacggactgccttatattggaccgatggcggatcaccccaatatctatttggccacggggcatgccatgatgggttggagcctagggccagtaacgggccatatgattgcagatatgatttctgagcgcacaccggtcttggattcacctcacctgcgtgttgatcgaaaattttag

SEQ ID NO: 378 - protein, 414 aa, Unknown
  Obtained from environmental sample
  DOMAIN (4)...(395): FAD dependent oxidoreductase
  SITE (319)...(322): N-glycosylation site. Prosite id = PS00001
MSKKVVVIGSGIVGASCAYYLHKAGHEVVLLEKEQQGSGASYVNAGYITPSHIIPLAAPGMVQMGMKYLFDSSGPFYMKPRFDLDFIKWAWAFQKSCTKSNVQKAIPLIKALNIHSRELYEELLSCGDLGEFHWEDKGLLMVYKTQKAADSEGLVAEEARSLGLEVDQLDTNRLRELEPGFGEEVLGAWHYHCDRHSTPTDVLPRLLKYLRQHISFQKSKGVDHIKSTSLGVSLKCGQESLTADRVVIAAGVWSSQLAKQLGQRLHLEAGKGYRIDVENELNIGMPAISLEHKIAVTPMKGFTRFAGTMEFSGINTTVRPERVAAIAKAAQSLYANLDFSEQDLASAATGMRPVSPDGLPYIGPMADHPNIYLATGHAMMGWSLGPVTGHMIADMISERTPVLDSPHLRVDRKF

SEQ ID NO: 379 - DNA, 1257 bp, Unknown
  Obtained from environmental sample
gtgcgcgttctcatcattggcggtggactgatcgggctctgcagtgcgtacgagctgcgtaagctcggacacgaagtcacgatcatcgaacgtcgcgagggccccgccctcgaaaccagtttcgcaaacggcggattgctcacgccgagcatgtccgatccgtggaacgcgccggggagttggcgcgtgctgctcgcgtccctcgggcgttcggattcgccattgcagctgcggctgaaggccgtacccggcctcgcgcactggggcatcgacttcctgcgcaactcgagctccgcgcgattcgcacgcaataccctcaacaatgttcgcctggcgcagtattcgctgagtgcgctccgggagctgcgacggaccgagcgactcgaatacggacaaggcacggctggcacgatgcggctgtttcgcgaccgggacaaattcgccgcagcccagaaggcctccgcagcactcaccactgaaggcatttcgtcgcgcagcctggctcctgcggaggcgaccgtactcgaacccgcactgacagccatcgagcgccaactcgtcggcgcgatccactattccggcgatgaatccggcgatgcgtacgtcttctgccggcttctcgctgatcgagcgcaaaacctcggcgtcgaaattcgcttcaaccaggacgtgaaagcgctcgaggtccgcaacggcgccgtcgtgtccgctcgctgcggagcggacacattgcatgccgatcgcatcgtcgtcgccgcgggcagctacagtgcgccgttgttgcaacaggtgggggtcgacctgcccgtgcggccggggaaaggttactcggtcagtttcgatcgaccacgcgaacacagcctcagtatcgcgatgatcgatgatgacctgcacgccgcgctcactccgctagggaacacgctgcgcgccgcgggtaccgccgagttcgcgggattcgacctcacgctgcgacccgagcgcgtgcgcaacctgatgggcctggtcaatcggatcctgccgaagtcgaacatcgatctttccaaaggacggccgtggtgtggattccggcccatgtcatcagacggagtaccgatcatcggcagcaccccggttaccaacctgtgggtcagcagtggccacgggcctctcggctggaccatgtccgtgggctcaggtcgcttgctcgctcaactaatgagcgatctcaagcccgaaattgatcctacgccttacgcgctcgcacgctttgcatcctga

SEQ ID NO: 380 - protein, 418 aa, Unknown
  Obtained from environmental sample
  DOMAIN (2)...(398): FAD dependent oxidoreductase
  SITE (96)...(99): N-glycosylation site. Prosite id = PS00001
MRVLIIGGGLIGLCSAYELRKLGHEVTIIERREGPALETSFANGGLLTPSMSDPWNAPGSWRVLLASLGRSDSPLQLRLKAVPGLAHWGIDFLRNSSSARFARNTLNNVRLAQYSLSALRELRRTERLEYGQGTAGTMRLFRDRDKFAAAQKASAALTTEGISSRSLAPAEATVLEPALTAIERQLVGAIHYSGDESGDAYVFCRLLADRAQNLGVEIRFNQDVKALEVRNGAVVSARCGADTLHADRIVVAAGSYSAPLLQQVGVDLPVRPGKGYSVSFDRPREHSLSIAMIDDDLHAALTPLGNTLRAAGTAEFAGFDLTLRPERVRNLMGLVNRILPKSNIDLSKGRPWCGFRPMSSDGVPIIGSTPVTNLWVSSGHGPLGWTMSVGSGRLLAQLMSDLKPEIDPTPYALARFAS

SEQ ID NO: 381 - DNA, 1251 bp, Rhodococcus ruber DSMZ 44319
atgacggttcgtcggacggtggtcgtcggtgcgggcatcgtgggtctgtccaccgcgtggttcctgcaggaacgcggtatcgaggtcacggtgctcgatcgggtcggcgtggcgggcgacgcgtcgtggggcaacgccggatggctcgcgccggctctgaccctgccgctgcccgagccgggggtgctgcgttacggcttgcgctcgatgttccggccgtcctcgccggtgtacgtgccgcccacgacggatctgcggttgctgcgcttcctcgccgacttcgcgcggcactgcacgagacggaaatggacgtcgtcgatggaggtcttcgcgcgcgccaaccgcgtcgccctcgacgcctacgacgatctcgcccgcgggtcgggcgacacgatcgtcaccgagccgacgcgggtcgccgatccgttcctcgcggcgttcacctcggacgacgatcgacggctgctggtcgaggagttcgagcacgcacgtgccgcaggcagcgagatcgatttcgacctgctcgacaccgacacgctgcattcgctcgaaccgctgctcggggacccggtgcgggtcgggctccggatccgggggcagcggttcatcgatccgccgcggttcgtcgcctctctggcgcacgcggtccgcgcccggggcgcggagatcgtcaccgatgtcgacgtccaggaggtgcgcgacaccggtcgcggggtggacgtcgtcgtggccggtggcgactcccgttcggcggatgcggtggtgctcgcgaacggagcgtggcttgggcctctcgcccggccgttcggtgtgcgcacgcaggttcaggccggtcgcggctacagcttcagcgtgcggccgccgagcctgccgaagaacccggtctacttccccgcccagcgggtggcgtgcacacccctccaggaccgcttccgggtcgccggcatgatggagttccgcagccccgacgccccgctcgacccgcggcgcatcgaggcgatcgtcgacgcgacccgaccgctgctgcgcgatgtcgactgggacgggcgcagcgaggagtgggtgggctcgcgtccgtgcacggcggacgggctcccgctgatcggccgcacgcgttcggagcgggtgtacgtcgccggcgggcacgggatgtggggtgtggcgctcggtcccctcaccggacggctgctcgccgggtcgatgaccggcgagccggatccgttgctcaggtcgttcgatccgctgcgctga

SEQ ID NO: 382 - protein, 416 aa, Rhodococcus ruber DSMZ 44319
  DOMAIN (5)...(400): FAD dependent oxidoreductase
MTVRRTVVVGAGIVGLSTAWFLQERGIEVTVLDRVGVAGDASWGNAGWLAPALTLPLPEPGVLRYGLRSMFRPSSPVYVPPTTDLRLLRFLADFARHCTRRKWTSSMEVFARANRVALDAYDDLARGSGDTIVTEPTRVADPFLAAFTSDDDRRLLVEEFEHARAAGSEIDFDLLDTDTLHSLEPLLGDPVRVGLRIRGQRFIDPPRFVASLAHAVRARGAEIVTDVDVQEVRDTGRGVDVVVAGGDSRSADAVVLANGAWLGPLARPFGVRTQVQAGRGYSFSVRPPSLPKNPVYFPAQRVACTPLQDRFRVAGMMEFRSPDAPLDPRRIEAIVDATRPLLRDVDWDGRSEEWVGSRPCTADGLPLIGRTRSERVYVAGGHGMWGVALGPLTGRLLAGSMTGEPDPLLRSFDPLR

SEQ ID NO: 383 - DNA, 1260 bp, Unknown
  Obtained from environmental sample
atgatgaagatcatggtgctgggcggtggcgtcatcggtgtgaccaccgcctattatcttgccgaagccggccacgaggtgacggtgatcgagcgccagcaaggcccggcgctggaaaccagcttcgccaatgccggcgagatttcgcccggctatgcctcgccctgggccgggcccggcgttccgctgaaggctatcaaatggctgctgatgaagcatggtccgctggtggtgcggccggccttcgacccgcatatgtggggctggctggtgaaaatgctgcgcaactgcaccactgagcgctacgcgatcaacaagtcgcgcatggtgccgctggccgaatacagccgcgacacgctgaaggcgctgcgcgaagcgaccggcatcacgtatgacgaacggagccagggcacgctgcagctgtttcgcacgcaaaagcagctcgacggaacatcaggcgatgtcgaggtcctgaagaaatatggcgtgccctacgagatcctcgagcgggacggctgcatcggtgcggaaccggggctggccggcgtgcgcgagaaattcgtcggcggcctcaggctgccgcatgacgagaccggcgactgcaagatgttcaccgacaaactggctgagctttgcgtggcacgcggcgtcaaattcgaatacggcgtgacgatattgcgggccaatcgcaacagcaacagcatcgccaatctcagcaccgacaagggtgtgagaacggccgaagcctatgtgatggcgctgggcagctactcggcaggtttcatgcgtgggataaagcggccgatcccggtctacccagtcaagggctattcaatcacggtgccgatcaaggatgccgccgccgctcccgtatcgacggtcatggacgagacctacaaggtggccatcacccggctcggcgatcgcatccgcgtcggcggcaccgccgagatttcggggttcgatctcagactgcacgaatcgcggcgccgcacgctggaacactcggtcggcgatctttttccgggcgccggcgctctgcgggacgcgaccttctggtgcgggctgcggccgatgacgccagacggaccaccgctgatcgggcgcaccgagttttccaacctttatctcaacaccggtcacggaacgctcggctggaccatggcctgcggctcggccagggtgctggccgacatcatatcgagccgggcgcccgatatagacgtccgcgctctggcgcaggagcgctatctagaatag

SEQ ID NO: 384 - protein, 419 aa, Unknown
  Obtained from environmental sample
  SIGNAL (1)...(21)
  DOMAIN (3)...(399): FAD dependent oxidoreductase
  SITE (97)...(100): N-glycosylation site. Prosite id = PS00001
  SITE (106)...(109): N-glycosylation site. Prosite id = PS00001
  SITE (240)...(243): N-glycosylation site. Prosite id = PS00001
MMKIMVLGGGVIGVTTAYYLAEAGHEVTVIERQQGPALETSFANAGEISPGYASPWAGPGVPLKAIKWLLMKHGPLVVRPAFDPHMWGWLVKMLRNCTTERYAINKSRMVPLAEYSRDTLKALREATGITYDERSQGTLQLFRTQKQLDGTSGDVEVLKKYGVPYEILERDGCIGAEPGLAGVREKFVGGLRLPHDETGDCKMFTDKLAELCVARGVKFEYGVTILRANRNSNSIANLSTDKGVRTAEAYVMALGSYSAGFMRGIKRPIPVYPVKGYSITVPIKDAAAAPVSTVMDETYKVAITRLGDRIRVGGTAEISGFDLRLHESRRRTLEHSVGDLFPGAGALRDATFWCGLRPMTPDGPPLIGRTEFSNLYLNTGHGTLGWTMACGSARVLADIISSRAPDIDVRALAQERYLE

SEQ ID NO: 385 - DNA, 1245 bp, Unknown
  Obtained from environmental sample
atgaacgtaacaattattggtgggggcgtgatcgggttgaactgcgcttattttttgcaaaaggaaggacacaaggtgacagttattgatcgtggagatattaccgatggatgttcctttggtaatatgggttatgtttcgccatcgcattttattccattggcaacgcccgggattgtatcaaaagggttgaagtggatgatgagctcttcatcaccattttatataaaaccacgattgaatctcgatcttattcgctggggaatgacattctggaagagtgcgactgcaaaaaaaattgaagagaatgcaccgcacatgaataatctgctgcaattgacccggcatttgatgaatgatgttaaaaatgaattgcctgaatcctttgacatgacagaaaaaggatgttggatgctttggaaaagcgaaaagacaggtgatcatgaaaagcatttggctgagcaggcagatcgttacgggctgaaaacaattttttgtacaccacaacaagtgcaggagcacgagacccaggtagagacaagcgttgcaggtggtgtattgtatcttgacgactgtcatgtaaatcctggcaagtttatgcattcgatgtattcctacttaaaaagtaaaggcgtacaattttggttgaatacgaatgttacaagttttgaaacatccaatggtaagattaccgccattataaccgataaatcaaaacttgattgcgatgagttggtattagcaaacggctcctggctacagaaaatttctaaattgctaaatatttatactccactacaacccggtaagggttatagtatggtgtatgaggggctgcaaaagaatttgcagtatcccgctatactggttgatgaccgaactgcaacaacaccgatcaatggctggctgagaattggtggtacaatggagttgagtggtcatagtgataatattttaccgaaaagagtaatggcgatttataatgcttttaaaaaatattatccaacaatgaatttgccacagcctaatatcaataaagcctggtttggttatcgtcctgtgagtccggatggcatgccatatattggaaggcataaaaaatattccaatcttagttatgctggcgggcatgcaatgttgggggttactgcggcggctggaacaggaagacttattgaagagattatttcagggaaaaaatcctcgtttgcattggaagcttttgagccatcccggttcgaatga

SEQ ID NO: 386 - protein, 414 aa, Unknown
  Obtained from environmental sample
  DOMAIN (2)...(395): FAD dependent oxidoreductase
  SITE (2)...(5): N-glycosylation site. Prosite id = PS00001
  SITE (222)...(225): N-glycosylation site. Prosite id = PS00001
  SITE (252)...(255): N-glycosylation site. Prosite id = PS00001
  SITE (375)...(378): N-glycosylation site. Prosite id = PS00001
MNVTIIGGGVIGLNCAYFLQKEGHKVTVIDRGDITDGCSFGNMGYVSPSHFIPLATPGIVSKGLKWMMSSSSPFYIKPRLNLDLIRWGMTFWKSATAKKIEENAPHMNNLLQLTRHLMNDVKNELPESFDMTEKGCWMLWKSEKTGDHEKHLAEQADRYGLKTIFCTPQQVQEHETQVETSVAGGVLYLDDCHVNPGKFMHSMYSYLKSKGVQFWLNTNVTSFETSNGKITAIITDKSKLDCDELVLANGSWLQKISKLLNIYTPLQPGKGYSMVYEGLQKNLQYPAILVDDRTATTPINGWLRIGGTMELSGHSDNILPKRVMAIYNAFKKYYPTMNLPQPNINKAWFGYRPVSPDGMPYIGRHKKYSNLSYAGGHAMLGVTAAAGTGRLIEEIISGKKSSFALEAFEPSRFE

SEQ ID NO: 387 - DNA, 1251 bp, Unknown
  Obtained from environmental sample
gtgaggatcgtcgtcctcggcgccggcgtcgtcggcacgacggcggcctattgcctggctcgggacggtcacgaggtggtcgtcgtcgagcggcacgcggccgtcgcgcacggcaccagctattccaacgccgggctggtttcgccaggcgacgctacagcgtgggcgtcgcctgccgcgctcagaaccttcttgcagtcgctctataggcccgatctcggcatcaaggtcaggttgcggttcgatccctacttcattttgtggagtctgcgctttctggcccagtgcacgactgcgcgctgccgtgcgaacacagaggtcaagctcaggctggcgctctattcccgcacctgcatcaacgagatcgcagccgaggccggtatcgactacgaccagcgggcaagaggtatcctctacttcttccggtccgagcagagcctggccgccggcaccggcaacctcaaatatctcgccgagcacgggcttcggatcgaaatcgtcgaccgcaaccggctgctcgagctcgagcccggtctcgccggcgccagggacacgatcgcaggcggcgtctattcgccgatggaccagaccggcgattcacgactgttcgtcgagaggctcgcggcacatgcggccgaacggctcgcggtggagttccggttcggcacgacggtccagggattggacgtcggccgggaccgtgtccgcgccgtgaagacgtcccacgggccgattgcggccgatgcggttgttgttgcgatgggtcccgaaagcgggctgctcggacgcaaatatggcatcgacctgccggtctatccggtgaagggctacaccgtgacggtgccgctcaggaaccccggcaagggaccgaccatgggcggcgtcgacgaggatcgactgatcgcctattcgcgcctcggcgatcgactgcggctcgccgcgaccgccgagttcgccggcttcgaccgcagccacaagccgagcgatttcgcggcgctgttccgtacggctcacgagctcttcccggatgcgttcgacgaaagcgaggcggagcggtgggcgggacttcggccgatgatgcccaactccgtcccggtcatcggccgcgcgaggtacagcaacctgttcctcgacaccggccacggccatgtcggctggacgatggcggcgggatcggcacgcctgcttgccgatctggtcgcggggcgcaagcctgccatcgatccgacgggactgctctacaagtcgtag

SEQ ID NO: 388 - protein, 416 aa, Unknown
  Obtained from environmental sample
  SIGNAL (1)...(20)
  DOMAIN (2)...(399): FAD dependent oxidoreductase
  SITE (290)...(299): Aminoacyl-transfer RNA synthetases class-I signature. Prosite id = PS00178
MRIVVLGAGVVGTTAAYCLARDGHEVVVVERHAAVAHGTSYSNAGLVSPGDATAWASPAALRTFLQSLYRPDLGIKVRLRFDPYFILWSLRFLAQCTTARCRANTEVKLRLALYSRTCINEIAAEAGIDYDQRARGILYFFRSEQSLAAGTGNLKYLAEHGLRIEIVDRNRLLELEPGLAGARDTIAGGVYSPMDQTGDSRLFVERLAAHAAERLAVEFRFGTTVQGLDVGRDRVRAVKTSHGPIAADAVVVAMGPESGLLGRKYGIDLPVYPVKGYTVTVPLRNPGKGPTMGGVDEDRLIAYSRLGDRLRLAATAEFAGFDRSHKPSDFAALFRTAHELFPDAFDESEAERWAGLRPMMPNSVPVIGRARYSNLFLDTGHGHVGWTMAAGSARLLADLVAGRKPAIDPTGLLYKS

SEQ ID NO: 389 - DNA, 1317 bp, Unknown
  Obtained from environmental sample
atgaaagtcatcgttttgggttcgggcatcatcggcactgcttcagcgtggttcttgaacaaggccggacatgatgtgacagtcatcgaacgccagcccggcgctgctcaggaaaccagtttcgccaacggctgccagatttcggtatcgcacgcggaaccctgggccaatccttccgccccgaagaaaatcttcaaatggctgggtcaggaagacgcgcccctgctttaccgcttccgtcccgaatggctgcaatggaaatggggaatgcacttcctgcgtgaatgcactcccgcgcgcacggcctataacatccgccagatcgtggccatcgcggaatacagccggcagacgctgcaggcggtgcgcgccgaaaccgggatcgaatatgatcacctgactcggggcattctgcatttttataccgacgaaaaggagttcgaagagtcgttgccggccgccaagctcatgcgtgatctcggttgcccgcgcgagtcgatcggcgcggatgaagtcgtgaagatcgagccggcgctcatgggaatccgcgacaggatcgtcggcggcgactttacacagacggacgaatcgggcgatgtgttcaaattcacgaccggcctggccgccagggcagcgcaggccggcgtcgaattccgcttcaacaccaccgtcacgcgcctgctgaacgaagggtcgggtgcgtcggccaaggtcactggcgtggaaatcatcgatccgcaaggccgtcatcaggtgctgcgcgccgatgcgttcgtgctggccatgggcagcttctcggtgccgctggtcaagccgctggggatcgacctgctgatctatccgggcaagggatattccgccacctatgcggtcaaggacgccgctgccgcaccaaccgtgtcgctgaccgacgatggatacaaactggtgatctcgcgcctcggcgatcgcctgcgcgtggccggcacttgcgaactcaacggttatacccgggaactcaacagtacccgctgcgaggccatcacgcgccgcacccgggagctgtttccggacgcctgcgactacgataatccggttttctggaccgggctgcgtccgctcacgccgtcgaatgtgccgtacatcggcaagacgaagatcggcaacctgtatctcaacaccggccacggcacgctgggctggaccatgggttgcggttccggtcgcgcgatcgcggaaatcgtttccggccgtgttcccgaaatcgactttgccttcaccggcgtcgatcgtgatccggccaagggggggatcatgtcacatcccgcgcgcgcctga

SEQ ID NO: 390 - protein, 438 aa, Unknown
  Obtained from environmental sample
  DOMAIN (2)...(407): FAD dependent oxidoreductase
  SITE (224)...(227): N-glycosylation site. Prosite id = PS00001
  SITE (339)...(342): N-glycosylation site. Prosite id = PS00001
MKVIVLGSGIIGTASAWFLNKAGHDVTVIERQPGAAQETSFANGCQISVSHAEPWANPSAPKKIFKWLGQEDAPLLYRFRPEWLQWKWGMHFLRECTPARTAYNIRQIVAIAEYSRQTLQAVRAETGIEYDHLTRGILHFYTDEKEFEESLPAAKLMRDLGCPRESIGADEVVKIEPALMGIRDRIVGGDFTQTDESGDVFKFTTGLAARAAQAGVEFRFNTTVTRLLNEGSGASAKVTGVEIIDPQGRHQVLRADAFVLAMGSFSVPLVKPLGIDLLIYPGKGYSATYAVKDAAAAPTVSLTDDGYKLVISRLGDRLRVAGTCELNGYTRELNSTRCEAITRRTRELFPDACDYDNPVFWTGLRPLTPSNVPYIGKTKIGNLYLNTGHGTLGWTMGCGSGRAIAEIVSGRVPEIDFAFTGVDRDPAKGGIMSHPARA

SEQ ID NO: 391 - DNA, 1257 bp, Unknown
  Obtained from environmental sample
gtgagttcgacacgcagagtcatcgtcatcggcggcggagtcatcggcgcggccagcgcgtactttctgaatcgcgccggctggcaggtcacgatcatcgaaaaaaacgaatacggccgcggctgctcgcacgcgaactgcggattcgtcagccccagccacattttgccgctcgctgaacccggcgtgctgatgaaaacggcgcgtacgatgttcaagaaggactcgcccttttacatcaagccgcgctacgatccggtgctctggaaatggctgtacaatttcgccggccgctgcaacgtgaaagacatgctgcaatccgcgcaggccattcatgcgctgctgcaatcatctcgcacgctctaccgcgaggtcatcacagaagaaaagttggactgcgaattcgaagaacgcggcctgctgatggtttttcgcacgcaggctaagatgaatgtcttcgcggagaccgatgcgctgctgcacgagaaattcaacgcgcccgcgcggcgctttgacggcgacgcgctgaacgattttgagccggcgctgaaacgcgggcttgcgggcggctggctctacgaaatggatgcgcacttgcgaccagacaagttgatgcgcgaatggcggcgcgtgctaacttcacgcggcgtaaaaattctggaacgctgcgaagtgcacggtttcgagccgcagagcggcagtgccggcgcactgaaaaccgcgctcggcaccttccatgcggacgagtatgtgctcgccgccggcgccctgacgccgcgtatgaatgacgccctgggcgtgcggattcccattcagcccggcaaaggttattccatgaccatgccgcgcacaaaacagtgccccaagtatcccctcatttttccggagcataaggtcgcggtcacgccgatgcagtccggctacaggctgggctcgatgatggaattctgcggctacgattctcgcgtcgacccgcagcgtttgcagattttgcgccgcggagccgagcattatttgcaggaaccgtattgcgagccagtcgtcgagaaatggtgcggctggcgcccgatgacatacgacagcgtgccgatcatcgaccgcagcccggcgctgcgaaatgtgctgatcgccgccggccacaatatgcttggactttcgatgagcaccgggactggcaagctggtgagcgagattctttcgggcgcggagccgcacgttaataaagatttgtattcgctggcgcgtttcaaatcctga

SEQ ID NO: 392 - protein, 418 aa, Unknown
  Obtained from environmental sample
  SIGNAL (1)...(20)
  DOMAIN (6)...(398): FAD dependent oxidoreductase
MSSTRRVIVIGGGVIGAASAYFLNRAGWQVTIIEKNEYGRGCSHANCGFVSPSHILPLAEPGVLMKTARTMFKKDSPFYIKPRYDPVLWKWLYNFAGRCNVKDMLQSAQAIHALLQSSRTLYREVITEEKLDCEFEERGLLMVFRTQAKMNVFAETDALLHEKFNAPARRFDGDALNDFEPALKRGLAGGWLYEMDAHLRPDKLMREWRRVLTSRGVKILERCEVHGFEPQSGSAGALKTALGTFHADEYVLAAGALTPRMNDALGVRIPIQPGKGYSMTMPRTKQCPKYPLIFPEHKVAVTPMQSGYRLGSMMEFCGYDSRVDPQRLQILRRGAEHYLQEPYCEPVVEKWCGWRPMTYDSVPIIDRSPALRNVLIAAGHNMLGLSMSTGTGKLVSEILSGAEPHVNKDLYSLARFKS

SEQ ID NO: 393 - DNA, 1257 bp, Unknown
  Obtained from environmental sample
atgaaaatcctcgtgatcggtgccggcgtgatcggcgtcgccaccgcctgggccttgcaggaagcggggcatacggtcaccttggtggatgcgcgcgaggcgccggggcgcggtgcttgttatgccaacggggcacagatctcggtgagccatccgcacccttggtccagccccagggcaccgttgatcgcgctggagtcgctcacacgcgaggacgggccattccgctggcgcccagcgctcgatacggcgcaatggtgctggctcacggcgtttctgcgcgaatgcctgccctcgcgccatgagcgcaacacgcgggcgattgcgctccttgcgcgccacagcctccaggtgctgcggcgctggcgcgaggcgctggggctcgagtacgacgtgcagacgcgcggcatcctgcaccttttcttcactccgcgcgactgggaaaccggccggcggcacgaggcggagctgcgtgagctgggcatcgccgcccgggcgatctcacccgcagaggcggcggaaatcgagccggcgctcgcgccggtggccgcgaagctctgcggcgccctgtacgcgccggaagacgaatcgggcgatgcgcgccgattctgcgaggagatggtggcgcggctgcgccaggccggggccgaggtgctcttcgagacgcgctggagcggctggcgtctgggcaaaggccgctgcgaagcggcacgcttcgaggggccggcgggggcgttcgagctcacggccgaagccatcgtcgtctgcgccggggtggacagcccgcgtctgctcgcacccctggggatggaggcgccgatctatcccgtcaagggctattcgctcacggcacccatcctcgcgccggagcgcgcgcccaccgcttcgctcaccgacgaatcgaagcgcatcgtgtgctcgcggcttggcaaccgtttgcgctttgccggtacggccgagatcgccggctacgacgactcggtgcgccccgagcgcatcgcgcccttgaagcgctgggccgaggtgatgctgcccggcgtggcggatctggaagcggccgaagcctgggcggggctgcggcccatgacgccgagcggcgtgccgctcatcgggcgcagtcccatggcaaacgtgtgggtgaacaccggccacggttcgctgggctggacgctcgcctgcggttcggcgcaggcgctgctcgcccggctggagggaaagacgccgcccgggctggaagcctttcccttcgtcggttga

SEQ ID NO: 394 - protein, 418 aa, Unknown
  Obtained from environmental sample
  SIGNAL (1)...(18)
  DOMAIN (2)...(402): FAD dependent oxidoreductase
MKILVIGAGVIGVATAWALQEAGHTVTLVDAREAPGRGACYANGAQISVSHPHPWSSPRAPLIALESLTREDGPFRWRPALDTAQWCWLTAFLRECLPSRHERNTRAIALLARHSLQVLRRWREALGLEYDVQTRGILHLFFTPRDWETGRRHEAELRELGIAARAISPAEAAEIEPALAPVAAKLCGALYAPEDESGDARRFCEEMVARLRQAGAEVLFETRWSGWRLGKGRCEAARFEGPAGAFELTAEAIVVCAGVDSPRLLAPLGMEAPIYPVKGYSLTAPILAPERAPTASLTDESKRIVCSRLGNRLRFAGTAEIAGYDDSVRPERIAPLKRWAEVMLPGVADLEAAEAWAGLRPMTPSGVPLIGRSPMANVWVNTGHGSLGWTLACGSAQALLARLEGKTPPGLEAFPFVG

SEQ ID NO: 395 - DNA, 1242 bp, Unknown
  Obtained from environmental sample
atgacaaaggacattgtggtactcggcgccggcgtggtgggcgtatgcacggcgctggcgctgcgccagcgcggccacgcggtggtgctggtcgatcgccaggcaccggggagagagacctcttacggcaatgccggcatcattcagcgagaggccgtgcaaccctatgcctttccacgggaatggcaggccatcctgcgggttgccctgcgccagggcaacgatgtgcactaccatcctggggcgctggcacacctggcaccggcgctggtgcgttactggcgcgagtcggcgcccgatcgctatgcctcggtcgtaaccgcctacagtgcgctgatccgccactgcctgagcgagcacgagcgactgatcaccctcgccggcgcacaagacctggtgcgcaagtcggggtggctacaggcctaccgcacggcgcgagcgttcgaccgggccgcgcgcgaggccagcacagtcgcgcgcgtgcacggcctggattgtcaggcgctcgaccaggctggcgtgacggccacggagccggccctttatgggcggctcgccggcgcgatccactggcgcgatccctggacggttgccgatcccggagagcttgtcacacgttatgccgcgctcttcgagcgcgagggtggcaacttccgccgcggcgatgccacgacgctgaagcctgccggcgccggctggaccgtgaccaccgaagaaggcccgctgagcgcggcacacgtggtgatcgcactcggtccatgggccgcggccctgatcgagaggctcggttatcgctttccgctattcgtcaagcgtggctatcaccgccactatgcggccgagccgatgccccggctgccggtgctcgacgtcgagaacggcgtcatgctggcgccgatgcagcggggcctgcgcctgaccacgggcgcggagtttgccctgcgcgatgcgccgccgacgcctgtccaattggagcgtgcagaaggctacgcgcgcgaactggtgcggctggggcagccagccgaagcgcagccgtggctcggcgcacgcccctgcgtggccgacatgaagcccatcgtgggcagggccccgggccatcacggtctctggttccactttgggcatggccatcagggcttcacgctcgggccagtcacggcacgtctgctcggcgagctgatcgacggcgagcaaccctacgtcgaccccttgccctacgatccaatgcggtttgccgtttga

SEQ ID NO: 396 - protein, 413 aa, Unknown
  Obtained from environmental sample
  DOMAIN (4)...(393): FAD dependent oxidoreductase
MTKDIVVLGAGVVGVCTALALRQRGHAVVLVDRQAPGRETSYGNAGIIQREAVQPYAFPREWQAILRVALRQGNDVHYHPGALAHLAPALVRYWRESAPDRYASVVTAYSALIRHCLSEHERLITLAGAQDLVRKSGWLQAYRTARAFDRAAREASTVARVHGLDCQALDQAGVTATEPALYGRLAGAIHWRDPWTVADPGELVTRYAALFEREGGNFRRGDATTLKPAGAGWTVTTEEGPLSAAHVVIALGPWAAALIERLGYRFPLFVKRGYHRHYAAEPMPRLPVLDVENGVMLAPMQRGLRLTTGAEFALRDAPPTPVQLERAEGYARELVRLGQPAEAQPWLGARPCVADMKPIVGRAPGHHGLWFHFGHGHQGFTLGPVTARLLGELIDGEQPYVDPLPYDPMRFAV

SEQ ID NO: 397 - DNA, 1245 bp, Unknown
  Obtained from environmental sample
atggcacgtactgatgtaatggtccttggtgccggtatcgtcggcacttcaatagcgcttcatcttgcaaggcgtgggctcagcgtcgcgctggtcgaccgcgccggcatcggcgaacagacgtcctatgggaatgccgggatcattgagggcaacacgattttcccgccggcttttccatccggttttagcgcgctgttgcgcatcgcattcaaacgcgcaagcgaagccaattatcacgtttcttttctgccgagcgttgctccctggctgctggcgttccgcgcggcctcccggccggaaaacctggctgaaaccgctcagctgatccggccgctgttttccagcgcggtcgccgagcacgagacgctgctggccgaggcaggcgcaaccaaatatctgcgcaaaaccgggtggctcaaagtttaccgcactgaaaagcgtttcaaatccctggcgcccgagttcgacttggccgcgaagttcggactgccgctgcggtcacttgatactgccggggcacaggcgctcgagccatctctcaatccggtcttcgcgcatggtgtgttctggccggaagccgcaagtatcagtaacccgctcggtgtgacgcgggcttatgcggcgcgttttgccgggctcggcggcgtctttctgaccggcgatgcgcggacgctgcaccgatccggcagcaattggcgggtagagacggagcagggagcgctcgacgcaagccagtgcgtgattgcgctcggtccctgggctcccgatctgttgaggcaactgggcatcaagctgccgctcgcggtaaagcgcggctatcaccggcacttcaacgcgcagggcaacgccgggcttgcgcgtcccgtgctcgacgcagacgtcggttacctgatcacgcctatggagcagggtatccgcatgacgaccggtgtggaattcgctgcacgcgatgcccagccttcgcccgtgcaatttgaccgcatcatgccccgggcccgtgagttatttccgctcggcgagcgggccgacgacagaacctggatgggtagccggccgtgcttgccggactcccggccggtgatcggccgcgcgccgagattgtccggactttggctggcggttggacatgcccactggggcttaacgcttggcccggcaaccggccgactcattgcggaaatgatggccggcgaaacaccgttttgcgatccggcgccgtacagttccgaacggtttagctag

SEQ ID NO: 398 - protein, 414 aa, Unknown
  Obtained from environmental sample
  DOMAIN (5)...(395): FAD dependent oxidoreductase
  SITE (368)...(380): Lipocalin signature. Prosite id = PS00213
MARTDVMVLGAGIVGTSIALHLARRGLSVALVDRAGIGEQTSYGNAGIIEGNTIFPPAFPSGFSALLRIAFKRASEANYHVSFLPSVAPWLLAFRAASRPENLAETAQLIRPLFSSAVAEHETLLAEAGATKYLRKTGWLKVYRTEKRFKSLAPEFDLAAKFGLPLRSLDTAGAQALEPSLNPVFAHGVFWPEAASISNPLGVTRAYAARFAGLGGVFLTGDARTLHRSGSNWRVETEQGALDASQCVIALGPWAPDLLRQLGIKLPLAVKRGYHRHFNAQGNAGLARPVLDADVGYLITPMEQGIRMTTGVEFAARDAQPSPVQFDRIMPRARELFPLGERADDRTWMGSRPCLPDSRPVIGRAPRLSGLWLAVGHAHWGLTLGPATGRLIAEMMAGETPFCDPAPYSSERFS

SEQ ID NO: 399 - DNA, 1242 bp, Unknown
  Obtained from environmental sample
atgaaagttacaattatcggtggcggagtcattggattgtgcagtgcttattacctgcaaaaaaacggctaccgggttactgttattgatcggcaggatatcacggaaggttgttcctttggtaatatgggttacatttccccgagtcattttattccattggctactcccggcattatatcccaggggttgaaatggatgatgagctcgtcaagccctttttatatcaagccaagactgaacctggatttgattaaatggggacttgcatttcgcaaaagcgcgaatgcaggaacagtagaactgaatgctcctcacctgaacaacctgcttcaattgagccgggaactgatgactgatttgaaaaaagatcttccgccttttgaaatgattgaaaggggttgctggatgttgtacaaatccgcaaaaacaggagaacacgaaaaacatattgctgaccaggcaaatcaattcggattaaaaaccattcaatgtgatgcggcgcaggtgcaggcttcggaaccggatgtggaagtaaatgttgccggaggtgttttgtatcaggatgactgccatgtaaggcccgaatcttttatgcaggctttatatgattatctgaaaaaggaaaaagtagaattctggctgaatacggaagtcacggggtttgaaaaggacaatggcaggataactgcgatacttacatcaaatggaaaatttgcggcggatgaaattatcatcgcgaatggctcctgggtgcccgaggtgtcaaaactgcttggcatatccatgctgatgcaaccgggaaaaggctacagtgtcgaatataatggactggaaaaaaacctgcggcacccgtcaatacttgtagatgatcgtactgctacatcgcctgttggcaaatggttacgtatcggcggaaccatggaactcagcggccatagcgataacattctgccaaaaagagtgatggccgtttacaatgcatttaaaaaatattatccttcaataaatatccctgcgcccaatgctcctgctgcatggtatggttacaggcccgtcactcctgatggcatgccgtacataggcaggcataataaattcagcaaccttatgtatgccggcgggcatgccatgctcggggtttctgcagctgccggtaccggcaaattaatggaagaaataaccggtaataaaaaaacaacgatcagtatagcagctttcgatccggaacgtttttcatag

SEQ ID NO: 400 - protein, 413 aa, Unknown
  Obtained from environmental sample
  DOMAIN (2)...(394): FAD dependent oxidoreductase
  SITE (251)...(254): N-glycosylation site. Prosite id = PS00001
MKVTIIGGGVIGLCSAYYLQKNGYRVTVIDRQDITEGCSFGNMGYISPSHFIPLATPGIISQGLKWMMSSSSPFYIKPRLNLDLIKWGLAFRKSANAGTVELNAPHLNNLLQLSRELMTDLKKDLPPFEMIERGCWMLYKSAKTGEHEKHIADQANQFGLKTIQCDAAQVQASEPDVEVNVAGGVLYQDDCHVRPESFMQALYDYLKKEKVEFWLNTEVTGFEKDNGRITAILTSNGKFAADEIIIANGSWVPEVSKLLGISMLMQPGKGYSVEYNGLEKNLRHPSILVDDRTATSPVGKWLRIGGTMELSGHSDNILPKRVMAVYNAFKKYYPSINIPAPNAPAAWYGYRPVTPDGMPYIGRHNKFSNLMYAGGHAMLGVSAAAGTGKLMEEITGNKKTTISIAAFDPERFS

SEQ ID NO: 401 - DNA, 1260 bp, Unknown
  Obtained from environmental sample
atgaaaacgcttgtactgggcggcggcattgcagggctctcgagcgcatttgcccaacaggagcgtggcgacgaagttgaagtcctcgaggcaagggaagctgttggcctggagaccagttttggaaacggcgggctgatgactgcctcgctctgtgagccctggaaccagccggggatatcccgcctgatgatcccagcgctttttggcggcaaaaactccatgctgcggattcatccccgggcattgccctcgctggcggtctgggggctcaagtttctcgccagctctggccaggcgcagttcctggagtcctcggcggcgcagtaccgactgtcgacctactcccaggaaaagacacgcgccctgatccaggagcagggcttcgatatcaagttccagaacaacggcatcctgcaggtgttcagggaccgggaagccctcgatcacgcgatagcaatccaccgccagtacgattcatttggcctgtcctacgaggtgctggataagccggctgcattgcagagtgagcctcacctcgaacacagcgccgatgacctggttggcgcaatctattacgaggacggcagtcgcggcgagtgtcccatgttctgtgaacaactggccgggttgctggagtcacgcggcgcggttattcgcaccggcgcacaggttcagaaaatcctggtggagcggggccgcgcggtaggcgtaatgacaagcgatggcgaagtacgcgcggacagggtaatcgtcgcactgggtaatgccgcgcccgccgtgttgcgaacggctggcgtgggactgccgatacggcccgccaagggctacaccatcacggtgccagtcgaggcagagctgccaaaatcaatcatgctggatgtcgggttgcacatcggtattatcccgatccacgccgacaacaccttgcgtattgggggtggcgcggagttcgccctcaacgacaagaccttctacgagcgctatgccgagagttcctacggcaatgtcgagaagaccctcccgcacctggttcctcacctgaggcgcgaccaggcagaaacctgggccggtttccggccagtgtcctatgacggaaagccctttataggcgggtgcaagattgaaaacctatacatcaatgggggactggggcacatgggttggacccagggcatgggtgccggtgcactattggcggacgtgatagcgggtacccggccagagattgaccccgacccctacaggttgcagcggtag

SEQ ID NO: 402 - protein, 419 aa, Unknown
  Obtained from environmental sample
  SIGNAL (1)...(18)
  DOMAIN (2)...(402): FAD dependent oxidoreductase
MKTLVLGGGIAGLSSAFAQQERGDEVEVLEAREAVGLETSFGNGGLMTASLCEPWNQPGISRLMIPALFGGKNSMLRIHPRALPSLAVWGLKFLASSGQAQFLESSAAQYRLSTYSQEKTRALIQEQGFDIKFQNNGILQVFRDREALDHAIAIHRQYDSFGLSYEVLDKPAALQSEPHLEHSADDLVGAIYYEDGSRGECPMFCEQLAGLLESRGAVIRTGAQVQKILVERGRAVGVMTSDGEVRADRVIVALGNAAPAVLRTAGVGLPIRPAKGYTITVPVEAELPKSIMLDVGLHIGIIPIHADNTLRIGGGAEFALNDKTFYERYAESSYGNVEKTLPHLVPHLRRDQAETWAGFRPVSYDGKPFIGGCKIENLYINGGLGHMGWTQGMGAGALLADVIAGTRPEIDPDPYRLQR

SEQ ID NO: 403 - DNA, 1257 bp, Unknown
  Obtained from environmental sample
atgtcaaaaaaaggcacctccgtcatcatcggtggcggaatttcgggtctggcttcggcctattatttgctcaaaagcggatggaaagtgacgttgctcgacaagggcgacttgttcgataactgctccatcggcaacgcgggcatgatcgtgccgagccattttatcccgctggctgctccgggcatggtttcgaagggtattaaatggatgttcaacagccgcagccctttttatgtaaaaccatccctcgatttctctctcatttcatggggtttgaaattcatgaaagcggccactgaggccaatgtagagcgcgcggcgccgcatttgcgggattatcatttattaagtaaaaagctttacgaagacctcgttcacgacgaaaacctggactttggcctggaagaaaagggtatattaatgctctacaaatccgataagaccggcgaagaggaaatccatgtagctaagcaaggccagcaactcggtctcgacatcgatatgctcaaccgcgagcaggtacaagcattggaaccgggcattaaactcgacgtagccggagctgtgcattaccgttgcgacgcgcatttgtacccgaccgctttggtgaatggcttgatcaaaagcattaccgcgctcggtgccgaaattgtcaaaaacacggaagtaacaggtttcgacattcaaaatggcgaaatcaaaagagtaaaaaccgctgccaaaacctacgaaggagatctggttgtcatgacgggaggctcctggctgccgcaactggccaaacacgccgggttatctattccggtaatgcctggtaaaggctactctttcatggagcccaactcccaacatcctattgtccaccctgcactactcctcgaagcccgcgtggccgttacgcctatgaacgggcaagtgcgcttcggcggtaccatggagcttgcgccgctcaacaatcagatcaatatgaacagggtggaggggatcgtcaattccatcccgcaatattatcctgaactcgatgtggccgttccgggaaaggaccgcatttggtacggtttccggccttgctcacccgatgggttgccctatctggggtattccagaaaattgagcaacctgatcgtcgccggtgggcacggtatgatgggtatcagcctcggacccggcaccgggaaaattgtggccgagctggcggagcgtgtgaagccttccgtagatgtagcgctctacgatccggaacgttatcaatag

SEQ ID NO: 404 - protein, 418 aa, Unknown
  Obtained from environmental sample
  SIGNAL (1)...(20)
  DOMAIN (6)...(399): FAD dependent oxidoreductase
  SITE (41)...(44): N-glycosylation site. Prosite id = PS00001
MSKKGTSVIIGGGISGLASAYYLLKSGWKVTLLDKGDLFDNCSIGNAGMIVPSHFIPLAAPGMVSKGIKWMFNSRSPFYVKPSLDFSLISWGLKFMKAATEANVERAAPHLRDYHLLSKKLYEDLVHDENLDFGLEEKGILMLYKSDKTGEEEIHVAKQGQQLGLDIDMLNREQVQALEPGIKLDVAGAVHYRCDAHLYPTALVNGLIKSITALGAEIVKNTEVTGFDIQNGEIKRVKTAAKTYEGDLVVMTGGSWLPQLAKHAGLSIPVMPGKGYSFMEPNSQHPIVHPALLLEARVAVTPMNGQVRFGGTMELAPLNNQINMNRVEGIVNSIPQYYPELDVAVPGKDRIWYGFRPCSPDGLPYLGYSRKLSNLIVAGGHGMMGISLGPGTGKIVAELAERVKPSVDVALYDPERYQ

SEQ ID NO: 405 - DNA, 1239 bp, Unknown
  Obtained from environmental sample
atggttcttggcgccggcgtggtggggctttgcaccgcccattatctccagcgccgtggttttcgcgtcaccgtggtcgatcgcgaaggtccaaaacgaagcagttgttcgtatggcaatgccgggctcatcgttcccagtcactttattccgcttgccgcgccgggtatggtcgccctgggcttgcgctgcatgtggaatcccgaatcgccattttatttgaagccgcggttctcggctcggttaatcaactggggctggaaattctggcgggcatcgacgcaaacgcgcgttgcccgggccgcgcctttgttgcgcgatttgaatttggccagccgagcggagtacgagcaattagtcggcgaactggatggcagcttcacgctggtgaaaaacggcgtcctgttgttgtgcaataccgagcacggtttgcacgaggaagcatgtgtggcggagcaaggaaaacaattgggattgcccgtggaagtgctcgacgccaggcaaacggcccagcaggatcccaacgtgaggatgaacgtcgtcggctcggtgatgtaccgctgcgattgccatctgacacccggccaggtcgtgcaatcgctgcaggcgagtctcgaatcgcgcggcattgcgtttcgatggaacacacacgttgatcaagtgcggcgcgaaggacgaaagatcgtcgccttctcggccgcgggtcaggaactcgaggccgatgagtatgtgatggcggccggcgtctggtccgacgacatgcttcggcaaatcggcgtgaacattcccatgcaggcgggcaagggttacagcctgacgctcaccaacccgccgcgcctgccacgaatgccttccattcttgtcgaaggccgtgtggcagtcacgccaatggggacttcgctgcgatttggcggcacgatggaactggccggcatcgaaacgaaaatcaaccctccgcgggtgcgcggcattgtcaagtcggcgctcgcctactttcccgatttcagcgaggccgactttgcagcggtcgaaccctggtgcggtctgcgtccctgcacgcccgacgggcttccctatttggggcgctcaacaaagttcgacaacctcaccattgccacgggccacgcgatgatgggcatgagtctggggccgatcaccggcaagatcgccgccgatttgattgcaggcgacagcccgccgttcgatttgcagttgttgtcgcccgagcgctacgactga

SEQ ID NO: 406 - protein, 412 aa, Unknown
  Obtained from environmental sample
  DOMAIN (2)...(393): FAD dependent oxidoreductase
  SITE (373)...(376): N-glycosylation site. Prosite id = PS00001
MVLGAGVVGLCTAHYLQRRGFRVTVVDREGPKRSSCSYGNAGLIVPSHFIPLAAPGMVALGLRCMWNPESPFYLKPRFSARLINWGWKFWRASTQTRVARAAPLLRDLNLASRAEYEQLVGELDGSFTLVKNGVLLLCNTEHGLHEEACVAEQGKQLGLPVEVLDARQTAQQDPNVRMNVVGSVMYRCDCHLTPGQVVQSLQASLESRGIAFRWNTHVDQVRREGRKIVAFSAAGQELEADEYVMAAGVWSDDMLRQIGVNIPMQAGKGYSLTLTNPPRLPRMPSILVEGRVAVTPMGTSLRFGGTMELAGIETKINPPRVRGIVKSALAYFPDFSEADFAAVEPWCGLRPCTPDGLPYLGRSTKFDNLTIATGHAMMGMSLGPITGKIAADLIAGDSPPFDLQLLSPERYD

SEQ ID NO: 407 - DNA, 1266 bp, Unknown
  Obtained from environmental sample
gtgaaagttctgatcctcggcagcggtgtcatcggcgtcacctccgcctactacctcgcccgtgccggccatgaggtgacggtcgtcgaccgtcagccggagccggcactggagacctctttcgccaatgccggcgaggtatcgcccggctattcctcgccatgggccggcccaggcgtgccggtgaaggcggtcaagtggctgttgatgaagcacggcccgctggtgatccggccgaagctcgatccggtgatgtgggtctggctgctgaagatgctgcgcaactgcaccagcgcgcgctacgcggtcaacaagagccggatgattccgattgcggaatacagccgcgatgccttgcgcgatctgcgccgccagatcggcatccaatatgacgagcgctcgcagggcaccctgcagctgtttcgctaccaggcccagctcgacggcaccgccgaagatatcgccgtgctgaagcaatacggcgttcccttcgaggtgctgagccgcgagggctgcatcgccgtcgagccggcgctgggcggcgtgaaggagaagttcgtcggcgggctccgcctgccgcaggacgagaccggcgattgccacatgttcacgcagtcgctggccaagcatgcccaggcgctcggcgtccgcttcatgttcaacacctcgatcgatcgcatcgtcaccgagggcgcgcgcgtcagcggcgtcgcgaccagcgccggcctgttgcaggcggacgcttacgtgctcgcgctcggcagctggtcgtcgcggctggcggcgccgctcggcatctcgctgccggtctatccggtgaagggctattcgatcacggtgccgatcaaggacgcttccggcgcgccggaatcgaccgtgatggacgagagctacaaggtcgcgatcacccgcctcggcaatcgcatccgggtcggtggcaccgcggaaatctccggctattcggacaagctctacgatgcgcgccgcgccacgctcgatcattcgctgaccgacctgttcccgcgcggcggcgatctcgccaaggcgacgttctggagcggcctgcgcccgatgacgccggacggcccgcccgtgatcggcccgacgcaatatgccaacctccacctcaacaccggccacggcacgctgggctggaccatgtcctgcggctcgggccgcgtgctcgccgacatgctgtcgggcaggaagccggagatcgacgtgagtgcgctgtcggtggagcgatacaagcaccggttcggctaa

SEQ ID NO: 408 - protein, 421 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
  SITE (224)...(227): N-glycosylation site. Prosite id = PS00001
MKVLILGSGVIGVTSAYYLARAGHEVTVVDRQPEPALETSFANAGEVSPGYSSPWAGPGVPVKAVKWLLMKHGPLVIRPKLDPVMWVWLLKMLRNCTSARYAVNKSRMIPIAEYSRDALRDLRRQIGIQYDERSQGTLQLFRYQAQLDGTAEDIAVLKQYGVPFEVLSREGCIAVEPALGGVKEKFVGGLRLPQDETGDCHMFTQSLAKHAQALGVRFMFNTSIDRIVTEGARVSGVATSAGLLQADAYVLALGSWSSRLAAPLGISLPVYPVKGYSITVPIKDASGAPESTVMDESYKVAITRLGNRIRVGGTAEISGYSDKLYDARRATLDHSLTDLFPRGGDLAKATFWSGLRPMTPDGPPVIGPTQYANLHLNTGHGTLGWTMSCGSGRVLADMLSGRKPEIDVSALSVERYKHRFG

SEQ ID NO: 409 - DNA, 1260 bp, Unknown
  Obtained from environmental sample
atgagcaagcacgtggtcattgttggcgcaggcgtcattggcctttccaccgcgtattattgcgcgcgccgtggcttcaatgtcaccgtcatcgagcgcaaaggcgcgcagcgcgacggcacatcgttcggcaacgcgggcatggtcgtgccgagtcatttcattccgctcgccgcgccgggcatggtggcgctcggcttgaaatggatgtggaatccagcgtcgccgttctacatcaagccccgtttcgatgcggcgttgctggattggggacacaaattttggcgcgccgccacacccgctcacgtgcaacgttccgcgccgctgatccgcgatctttcgtttgccagtcgcgcgtgttttgaagaattcgccgccttgcctagcgcgaattttgattttgtgacgaagggtttgctcatgttgtgccagaccgagcacgcgttgcatgaagagggcaagactgctgaacaggcacgggcgctcggtgttccggcggaagtgctcgacgcgaagcagaccgccgcgctcgactccggtgcgacgatgaagatcgccggctcggtttattttccgaaggactgtcatctttcgccggcaaaattcatggcgctgctgcaatccgaactggaaaagctcggcgtgaaattcgtttgggacagcgacgtcgtaaattggcagatcgaagcaggcaataaaatccgcgcggccaaactgagcaacggccaactaatcaaaggcgatgaattcgtgctgtgcggcggctcgtggtcgccgcaactcgccgagaaactcgcgctcaatatcccgatgcaggcgggcaaaggttacagtctcacgctgccgaagccgcgccaatcattgcagctctgctccatcctctgcgaagcacgcgttgccgtgacgccgatgggcgagacgttgcgcgtcggcggcacaatggaaatcgcaggtctcaacgaagacatcagtccggtgcgcgtgcggggcatcatcgattcgttctgccgctattatcccgagttcaagccgtcagatttcgacgcggtgcaaccgtggcgcggactgcggccctgttcgccagacggtttgccgtatgtcggacgcacggaaaattttgccaacctctcgctctgcaccggtcacgcgatgatgggcctgagccttggcccggtgagcggcaagttgatggcggaagttctcgccggtgaaaaaccgtcgcacgacctcacgctgctttctccggatcgttacaactga

SEQ ID NO: 410 - protein, 419 aa, Unknown
  Obtained from environmental sample
  DOMAIN (4)...(400): FAD dependent oxidoreductase
  SITE (27)...(30): N-glycosylation site. Prosite id = PS00001
  SITE (380)...(383): N-glycosylation site. Prosite id = PS00001
MSKHVVIVGAGVIGLSTAYYCARRGFNVTVIERKGAQRDGTSFGNAGMVVPSHFIPLAAPGMVALGLKWMWNPASPFYIKPRFDAALLDWGHKFWRAATPAHVQRSAPLIRDLSFASRACFEEFAALPSANFDFVTKGLLMLCQTEHALHEEGKTAEQARALGVPAEVLDAKQTAALDSGATMKIAGSVYFPKDCHLSPAKFMALLQSELEKLGVKFVWDSDVVNWQIEAGNKIRAAKLSNGQLIKGDEFVLCGGSWSPQLAEKLALNIPMQAGKGYSLTLPKPRQSLQLCSILCEARVAVTPMGETLRVGGTMEIAGLNEDISPVRVRGIIDSFCRYYPEFKPSDFDAVQPWRGLRPCSPDGLPYVGRTENFANLSLCTGHAMMGLSLGPVSGKLMAEVLAGEKPSHDLTLLSPDRYN

SEQ ID NO: 411 - DNA, 1239 bp, Unknown
  Obtained from environmental sample
atgaaacttgaaggactatcgttgatcggtggaaagcccggcgcgcggggcgggaaaatttttaccggcgtgaatcccgccacgggcgcgacattgccgggagaatttcactctgcttccgtggccgaagccgatgccgcggtgaaactggcgagtgaagcctttgccagttatgcacgatggtctggaaaacaacgcgcggcgttactcaatcgcaccgcagaattactggaagccaatgccgcgctcatcgtcgaacgcggcggactagaaacaggcctgcccgccgcgcgattgcaaggggagctggcgcggacgtgtttccagttgcgtttctatggcgaagcggcgggaagtggattagtggcgggtgcccggatcgatcatgcggatccaaaccgcaagccgctcccgaagcctgacctgcgctccgtgatgattccgctcggaccggtggtggtttttggcgcgagcaatttcccgctcgcctattccgtggcgggcggcgacacagcctccgcgctcgccgcaggttgtcccgtcatcttcaaggcacatccggcccatccgggtctttcggaaatcgtcggtcaactggtgacgcaagccgtgaaagaatccggcgctccggaaggattgttttccctgctgttcgatgccggccatgaagtgggcggcgcattggtgaaacatccgctcgtgaaagctgtcggcttcaccggctcgcggcaaggcggacggacattgatggatctggcggcagcgcggccggagccgattccggtttatgcggagatgggcagtgtgaatcccgtattcatcctttccgaagccttgaacacgaaggcggaagagatcgccgcgggcctgcacggttccgtaacgttgggcgtcggacaattctgcacgaatccaggactcgtctttgtcgaggcgggcgcgggtgcaaaatcatttctcaccaagctggaaacgctgatccaatccacaccagcgggcacgatgttgactgcgggcttgtgtgcggcttatcagcgcggcgtaaaaattttctctgctgtaacgggcgtcaaatccagcggcacgattttgccggacgccagcgctggcgccgctcaggccaacgccgcactttttgtcaccagcgcggaaacatttctgagcaaccatcgcttgatggacgaagtgttcgggccttcgacgctggtggtcgagtgcgcctcgcgcgaacaattcttt

SEQ ID NO: 412 - protein, 413 aa, Unknown
  Obtained from environmental sample
  DOMAIN (12)...(413): Aldehyde dehydrogenase family
  SITE (72)...(75): N-glycosylation site. Prosite id = PS00001
MKLEGLSLIGGKPGARGGKIFTGVNPATGATLPGEFHSASVAEADAAVKLASEAFASYARWSGKQRAALLNRTAELLEANAALIVERGGLETGLPAARLQGELARTCFQLRFYGEAAGSGLVAGARIDHADPNRKPLPKPDLRSVMIPLGPVVVFGASNFPLAYSVAGGDTASALAAGCPVIFKAHPAHPGLSEIVGQLVTQAVKESGAPEGLFSLLFDAGHEVGGALVKHPLVKAVGFTGSRQGGRTLMDLAAARPEPIPVYAEMGSVNPVFILSEALNTKAEEIAAGLHGSVTLGVGQFCTNPGLVFVEAGAGAKSFLTKLETLIQSTPAGTMLTAGLCAAYQRGVKIFSAVTGVKSSGTILPDASAGAAQANAALFVTSAETFLSNHRLMDEVFGPSTLVVECASREQFF

SEQ ID NO: 413 - DNA, 1248 bp, Unknown
  Obtained from environmental sample
gtggcacgtaccgatgcgatggtcctcggcgccggcattgtcggcacatcggttgccctgcatctcgccaaacgcggtctgagtgtcgccttggtcgaccgcgcgggcatcggcgagcagacgtcctatggcaacgccggcatcatcgaaggcaacacgatattcccgccggcatttccatccgatctcggcgcgttgttacggatcgccttcaagcgcgcgagcgaggccaactatcatttgtcctttctgcctcggattctgccctggttgctggcgttccgcgccgcttcgcaacccgaacgtctggccgaaacggcgcggctgatccgtccgttgttttcccgtgcagtggccgaacacgaagcgttgatggccgaggccggtgcgacacactacttgcgcaagacaggctggttgaaggtttatcgcggcgacaggagtttcgccgccctgtcgcctgagttcgatctggctgccaaatttaatttgccgctcaaggtcctcgatacggccgacgcgcaagcgcttgagccatcccttagtccggttttttcgcatgcggtgttctggccggaagcagccagcgtcagcagtcctctcggtgtgacgggcgcctatgccaaacgctttatcgccctcggcggcatcattgtttcaggcgatgcccagtcgctgcatcggagcggtaaaaattggcgggtggaaaccaacgaaggtgcgcttgacgcagcgcagtgcgtggttgcgctcgggccatgggcggtggatttgctggaccgccttggtctgagactgccgcttgcggtgaagcgcggctatcaccgccattttcgcgctgagggcaatgccggcttggcgcggccggtgcttgacgccgaagtgggctatttgatgaccccgatggagcagggcatccgcatcaccaccggcgccgaattcgccgcgcgcgatgcgccgccgaccccggttcagttttcacgcattacgcctcgggcccgcgaactctttcccttgggcgaaatggccgagaacaggacatggctcgggagccggccgtgctttcccgattcgcgtccggtgatcggtcccgcgcccggacttgccggtctgtggctggcaatcggtcatgcccactggggactcacgcttggtcccgcgacgggccgcctgatcaccgagatgatggcgggcgagcagcccttctgcgatccggcgccgtatcgggcgaatcgtttcaatcagtga

SEQ ID NO: 414 - protein, 415 aa, Unknown
  Obtained from environmental sample
  DOMAIN (5)...(395): FAD dependent oxidoreductase
  SITE (350)...(353): N-glycosylation site. Prosite id = PS00001
MARTDAMVLGAGIVGTSVALHLAKRGLSVALVDRAGIGEQTSYGNAGIIEGNTIFPPAFPSDLGALLRIAFKRASEANYHLSFLPRILPWLLAFRAASQPERLAETARLIRPLFSRAVAEHEALMAEAGATHYLRKTGWLKVYRGDRSFAALSPEFDLAAKFNLPLKVLDTADAQALEPSLSPVFSHAVFWPEAASVSSPLGVTGAYAKRFIALGGIIVSGDAQSLHRSGKNWRVETNEGALDAAQCVVALGPWAVDLLDRLGLRLPLAVKRGYHRHFRAEGNAGLARPVLDAEVGYLMTPMEQGIRITTGAEFAARDAPPTPVQFSRITPRARELFPLGEMAENRTWLGSRPCFPDSRPVIGPAPGLAGLWLAIGHAHWGLTLGPATGRLITEMMAGEQPFCDPAPYRANRFNQ

SEQ ID NO: 415 - DNA, 1242 bp, Unknown
  Obtained from environmental sample
atgagcaaagatgtcatcgtcctcggcgccggcatggtcggcgtatcaacggcgctgcaccttcagcagcgtggccgttcggtagcgctcgtcgatcggcgcggcgtggccgaggaaacgtcgtacggcaacgccggcatcattcagcgcgaggggatcgttccctatctctttccgcgcgattgggcgaccatccttcgccatgcacgcaaccagtcgacggaagtgtccttccaatggtcgtcgctgccgagcgtcgcgccgtggatgttcaagtattggagctggtcgaccgaagaggggatgcacgcgaccgcgcgcgccatggcgccgatcgtgacgcgctgcgtcgatgagcacgagcacctcatgaacgaggccggcgtcatcggcatgatccgcaggacaggctacctgcgcctctatcgcaacgagcaggggctcgagaaggccatccacgaggacaatcaggtcaaggccaagtacggcgtcgtttcgcagccgatcgatcgcgccggcctcgccgagatggagccacacctgaagcccatttacgtcggcggcatcttcctgcccgatccctgcagcgttgccgatccgagtgcgctcggcaaggcttacggcgatctcttcgtgcggcgtggcggcgctctggtcgagggcgaggcacgctcactgacgcgcgacggtgccggctggaaggtcgcgacgcgcgacggctggatctcggcgcccgatgtcgtcgtggcgctggggccatggtcagacatggtgacacgcgcgcaggggctcaagctgccgctcggcgtgaagcgcggctatcacatgcactatcatgccgagggcaatgcgacgctcaacaggccggtcatcgacacgtcgatcggttatgcgatggcgccgatgagcaaaggaatccgtgtcaccacgggcgccgagttcgcgacgcgcgacgcgccgccgaaccccgtgcagctcgagcgcgtcgagcctttcgcccgcgccgcgttcccgctcgcggagcgtgccgaggcggcgccctggctcgggcggcgcccctgcttcccggacatgctgccggtcatcggtcaggccgccagcaagaaaggcctctggatgaacttcggccaccaccatctgggtttcacgctcggacccgtgacgggtcgcctgctggccgagatgatgacgggcgagaagccgttcacggaccctcatccctatcgcgcggaacggttctga

SEQ ID NO: 416 - protein, 413 aa, Unknown
  Obtained from environmental sample
  DOMAIN (4)...(395): FAD dependent oxidoreductase
  SITE (72)...(75): N-glycosylation site. Prosite id = PS00001
  SITE (287)...(290): N-glycosylation site. Prosite id = PS00001
MSKDVIVLGAGMVGVSTALHLQQRGRSVALVDRRGVAEETSYGNAGIIQREGIVPYLFPRDWATILRHARNQSTEVSFQWSSLPSVAPWMFKYWSWSTEEGMHATARAMAPIVTRCVDEHEHLMNEAGVIGMIRRTGYLRLYRNEQGLEKAIHEDNQVKAKYGVVSQPIDRAGLAEMEPHLKPIYVGGIFLPDPCSVADPSALGKAYGDLFVRRGGALVEGEARSLTRDGAGWKVATRDGWISAPDVVVALGPWSDMVTRAQGLKLPLGVKRGYHMHYHAEGNATLNRPVIDTSIGYAMAPMSKGIRVTTGAEFATRDAPPNPVQLERVEPFARAAFPLAERAEAAPWLGRRPCFPDMLPVIGQAASKKGLWMNFGHHHLGFTLGPVTGRLLAEMMTGEKPFTDPHPYRAERF

SEQ ID NO: 417 - DNA, 1248 bp, Unknown
  Obtained from environmental sample
atgaagattaccattctgggcgcgggcgtcatcggcgtgacctcggcctattatctcgcgcgcgccggtcacgaggtgacggtcctcgatcgccagccgggcagcgcgctggaaacgagctttgccaatgccggcgaaatctcgccgggctacgcttcgccatgggctgcccccggtatcccgctcaaggccttgaaatggctgttcatgcagcacgcgccgctgatcatccgtccgatggcggaccgtgccacctggtcgtggatgctggagatgctgcgcaactgcacgtcggcccgctatgccgtcaacaaagggcgcatggtcaggctcgccgaatacagccgcgactgcctcatcgcgcttcgcgaggaaaccggcatcgcctacgaccatcgctgccaggggacgctgcagctcttccgtacgcagaagcagctcgattcgatcggcaaggacatcgacgtgctgcgcgccgacggcgtgcccttcgaagtgcttgatgtcgccggctgcgttgctgcggagcccggcctggcctcatcgcgcgacaagatcgtcggcggcctgcgcctgcccaatgacgagaccggcgactgctacaagttcacgaccgcgcttcagaagcatgccgaagccctgggcgtgcggttccgcttcggcgtcggcatccgcggcctcaaccgtcagggcgaccggatcgaatcgctttcgaccgaccagggcgacatcgtctcggacgttttcgtggcggcgctgggcagctacacgcccgctctcctcgagccgctcggcatcgacctgccggtctacccggtcaagggctactcgatcaccgtgccgatcgtcgacgaatcccgtgcgcccgtctccacaatcatggacgaaaccttcaagatcgccattacccgtctcggcgaccggatccgcgtcgggggtatggccgagatcgccggcttcagccacgatctgccggctgcccggcgggcgacgctcgaacattcggtcgaggacctgttcgggggtgccggcgaccagagccgcgcgaccttctggtccgggctccgtccgatgacgcctgatggtacgccggtgatcggctccacccgctacggcaatcttttcatcaatgccggccacggcacgctcggctggacgatggcctgcggttccggtcgcgttctggcatcattgatcggcggcaaagcgcctgaaatacgcgccgacgatctcggcctcgtgcgctag

SEQ ID NO: 418 - protein, 415 aa, Unknown
  Obtained from environmental sample
  SIGNAL (1)...(20)
  DOMAIN (2)...(398): FAD dependent oxidoreductase
  SITE (96)...(99): N-glycosylation site. Prosite id = PS00001
MKITILGAGVIGVTSAYYLARAGHEVTVLDRQPGSALETSFANAGEISPGYASPWAAPGIPLKALKWLFMQHAPLIIRPMADRATWSWMLEMLRNCTSARYAVNKGRMVRLAEYSRDCLIALREETGIAYDHRCQGTLQLFRTQKQLDSIGKDIDVLRADGVPFEVLDVAGCVAAEPGLASSRDKIVGGLRLPNDETGDCYKFTTALQKHAEALGVRFRFGVGIRGLNRQGDRIESLSTDQGDIVSDVFVAALGSYTPALLEPLGIDLPVYPVKGYSITVPIVDESRAPVSTIMDETFKIAITRLGDRIRVGGMAEIAGFSHDLPAARRATLEHSVEDLFGGAGDQSRATFWSGLRPMTPDGTPVIGSTRYGNLFINAGHGTLGWTMACGSGRVLASLIGGKAPEIRADDLGLVR

SEQ ID NO: 419 - DNA, 1326 bp, Unknown
  Obtained from environmental sample
atgaaagttcttgtcctcggcgccggcatcatcggcaccagcaccgcctggcacctgctcgagcgcggccacgaagtcaccgtggtcgaccgccaggacgccgccgcgcgcgaaaccagcttcgccaacgcgggccagatctccgtgagctactgcgagccctgggccaaccgccacgcgccggccaagctgctgaagtggatgttccgcaacgacgcgccgctgctgttccgcccgcagctcgattggcagcaatggcgctggggcctggagttcctcgcgcaatgcaacgacacggcgttcgagcgcaacgtgaagcagctggtggcgctcggaagctacagccacgccgcgctgaaggacgtggtccgcgccaccggcatcgaataccagcggctcgaacgcggcatcgcccactacttcaccgacgcgaaatcattcgaggaagccggacgcgccgccgaactgatgcagcgcttcggtgtcgagcgcaaggtcgtgtcgcgcgaagagctccttcgcatcgaacccgcgttcgcgcagtttgcgcatgagatggcgggcggcacctacaccgccagcgacgaaagcggcgatgcacgcctgttcacggagcaactggccgctcgctgcgccgcgcacggcgcccagttcctgtacgaacacgacatcgatcagctggaagtcgccggccgcgaggtctcggcggtgcgtgtgcgcgaccgcatcgccggcacggagcggcatcttcaggccgacgcggtggtggtggcgtgcggctcctacaccgcgcccctgctgcgcaccgtgggtgtggacctgccgatctacccgggcaagggctacagcgccacgttccgcatcaacaagccggaactcgccccgtacgtgagcacgatcgacgacgaggtcaaggtggcgatgagccgcttcggcgacgaactgcgcgtggccggcacgatcgagctggccggcttcgaccggtcgctcgactcgccgattgcccgcgcgcgctgccgcatgctggccgaccggatcgagaaggtgctgcccggcgtgtgcgacacgcgcaccgaggaagaaggcggcaccccgcgcttctggacgggcctgcgccctgccacgccgacgaacatcccatacatcggccgcacgcgcgtcggcaaactgtgggtcaacgccggccacggcacgctcggctggacgcacggcgcgggctcaggcaaggcgatcgccgagctgatcagcggcgagcagcccgccacggagttcaacttctacggcttcgagaagagcgctcagcgctactcaccgagcccggcctga

SEQ ID NO: 420 - protein, 441 aa, Unknown
  Obtained from environmental sample
  DOMAIN (2)...(414): FAD dependent oxidoreductase
  SITE (98)...(101): N-glycosylation site. Prosite id = PS00001
MKVLVLGAGIIGTSTAWHLLERGHEVTVVDRQDAAARETSFANAGQISVSYCEPWANRHAPAKLLKWMFRNDAPLLFRPQLDWQQWRWGLEFLAQCNDTAFERNVKQLVALGSYSHAALKDVVRATGIEYQRLERGIAHYFTDAKSFEEAGRAAELMQRFGVERKVVSREELLRIEPAFAQFAHEMAGGTYTASDESGDARLFTEQLAARCAAHGAQFLYEHDIDQLEVAGREVSAVRVRDRIAGTERHLQADAVVVACGSYTAPLLRTVGVDLPIYPGKGYSATFRINKPELAPYVSTIDDEVKVAMSRFGDELRVAGTIELAGFDRSLDSPIARARCRMLADRIEKVLPGVCDTRTEEEGGTPRFWTGLRPATPTNIPYIGRTRVGKLWVNAGHGTLGWTHGAGSGKAIAELISGEQPATEFNFYGFEKSAQRYSPSPA

SEQ ID NO: 421 - DNA, 1293 bp, Unknown
  Obtained from environmental sample
atgagcgcggcctcgtcgcctgctgctgagcgccgcatcccgccgctcgacccgtcgggccaggtcgcggtcatcggcgcgggcgtcgtcggcctgtcgaccgcgctgctgctggcccgcgcgggcgtgcccacgacggtgctcgagcgcggccaggtcgccgcgggcgcgtcatggggcaacgccgggttcctcactcccgcgttgaccacgcccctgccgcagccgtcgatgctgcgcaccggcatcaaggcgctgatcagcccacgctcaccgctgtacgtgccgttcaggctcgacccgcggctgtggtcgttccttgtagagctcgcccgccattgcacgaaccgcgcctggaccgcctcgatgcaggcctacgcgccgctggtgcgtgcgagcctgggcgccttcgacgagatcgtcgacgcgggggtgaccgacgtcgttcgcacgcccgagatcatcgtggcggcatgccgcgaggccgccgcgcgtgatcacgtcgtcgacgacctcgaggccgtgcggcacgcgggcatcgacgtcgacttcgagctgctcgaccggtcggcactgtcggccgtcgcgcctcacgtcggtccggcgatcacctcaggggtcgcggtccgcggccagcgcaccatcgacccacgccgcttcatggatcgtctggccgaggcggccacggcggccggggtgcaggtgcgcaccggcaccgaggtggtcgcgctgcgtgacgacggccggaaggtcgcggtcgatctcgccggcgacgagacgctgaccgtcgaggccgcggtggtggccaccggcgccgagctggccgcgctcgtgggaggcttcggggtgcgccggagggtgcacgccggccgcggctactcgttcagcgtggcctcggccatcgacgtgcccacctcgacgtggttcccgtccgacaagatcgtggccaccccgctcgacgacggcaggctgcgcatcgcaggcatgatggaattccgccggcacggcgatccgatcgacccccgtcgcatcgcggcggtcgccgacgcggcccgcggggtgctgccggcgttcgacgtcgacgatcggcgcgaggaatgggtgggctcacggccggtgaccgctgacggccggccgctgatcggcccgacctcctcgccacggatcatcgccgccggcggccacggcatgtggggagtcgtgctcgggccgctgaccggccggctcgtcaccaggatgctcgtcgacgggacggtggccagcgagctcgcacccttcgatccgctgcgctga

SEQ ID NO: 422 - protein, 430 aa, Unknown
  Obtained from environmental sample
  DOMAIN (21)...(413): FAD dependent oxidoreductase
MSAASSPAAERRIPPLDPSGQVAVIGAGVVGLSTALLLARAGVPTTVLERGQVAAGASWGNAGFLTPALTTPLPQPSMLRTGIKALISPRSPLYVPFRLDPRLWSFLVELARHCTNRAWTASMQAYAPLVRASLGAFDEIVDAGVTDVVRTPEIIVAACREAAARDHVVDDLEAVRHAGIDVDFELLDRSALSAVAPHVGPAITSGVAVRGQRTIDPRRFMDRLAEAATAAGVQVRTGTEVVALRDDGRKVAVDLAGDETLTVEAAVVATGAELAALVGGFGVRRRVHAGRGYSFSVASAIDVPTSTWFPSDKIVATPLDDGRLRIAGMMEFRRHGDPIDPRRIAAVADAARGVLPAFDVDDRREEWVGSRPVTADGRPLIGPTSSPRIIAAGGHGMWGVVLGPLTGRLVTRMLVDGTVASELAPFDPLR

SEQ ID NO: 423 - DNA, 1245 bp, Unknown
  Obtained from environmental sample
atgagtaatgttacaatagtcggcggtggcgtcattggtctttgcactgcctactatcttcgaaaagcaggtcaccaggtcacagttattgagaggaacgatattaccgatggttgttctttcgggaacatgggatatatctctccttcgcattttatcccgctcgccactccgggtattgtcaaacagggattaaaatggatgacgagttcctcttctcctttctatatcaaaccaagactgaactgggatcttattcgctggggaacgacattctggagaaaggccaatgcgaacacagtcgaaaaaaacataccccatctcaataacctgttgcagttaagccgcagactgatgaatgatctcgtaaaagaacttccgggttcatttgatatgaccgagaaaggctgctggatgttatataagaatgaaaagaccggtgatcacgagaagcatttagccgagcaggcgcattcactgggtttaaagaccattacttgtaatgcggcagaagtgcagcagcgcgaaacacaggtggaagtaaatgtagccggcggcgtattatacctggacgattgccatatcgattcatcgaagttcatgcgatcattgtatagttaccttcaaaagatcggtgtgaagttctggctgaatacaagcgtgacgggttttgaaaaagaaaatggtcgcattactgctgttattaccgataaaggagaattctattgtgaagaactggtcatagcgaatggttcctggatgggagagatatcaaaactattaggtataaagatgatgatacagccgggaaagggatacagtatcgtgtatactgatcttgcaaagaacctgcagtatccgtctattctcgtagatgaccgtactgctactacacccatcaaccaatggctacgtatcggtggaacgatggaattgagtggtcatagtgataatatccttcctaaaagagtaatggctatctataatgctttcaataagtattatccgaagatggatcttccgcaaccggatatttcaaaagcctggtatgggtaccgcccggttacgccggatggaatgccgtatatcgggagacatagcaaatacagcaatctcacttatgcaggtggacatgcaatgctgggtgtaagtgcggctgcaggaacggctttattgatcaaggaaattctttccaatgaaccggctacgattgaactcggagcatttgatcccggacgattctaa

SEQ ID NO: 424 - protein, 414 aa, Unknown
  Obtained from environmental sample
  DOMAIN (3)...(396): FAD dependent oxidoreductase
  SITE (3)...(6): N-glycosylation site. Prosite id = PS00001
  SITE (221)...(224): N-glycosylation site. Prosite id = PS00001
  SITE (253)...(256): N-glycosylation site. Prosite id = PS00001
  SITE (376)...(379): N-glycosylation site. Prosite id = PS00001
MSNVTIVGGGVIGLCTAYYLRKAGHQVTVIERNDITDGCSFGNMGYISPSHFIPLATPGIVKQGLKWMTSSSSPFYIKPRLNWDLIRWGTTFWRKANANTVEKNIPHLNNLLQLSRRLMNDLVKELPGSFDMTEKGCWMLYKNEKTGDHEKHLAEQAHSLGLKTITCNAAEVQQRETQVEVNVAGGVLYLDDCHIDSSKFMRSLYSYLQKIGVKFWLNTSVTGFEKENGRITAVITDKGEFYCEELVIANGSWMGEISKLLGIKMMIQPGKGYSIVYTDLAKNLQYPSILVDDRTATTPINQWLRIGGTMELSGHSDNILPKRVMAIYNAFNKYYPKMDLPQPDISKAWYGYRPVTPDGMPYIGRHSKYSNLTYAGGHAMLGVSAAAGTALLIKEILSNEPATIELGAFDPGRF

SEQ ID NO: 425 - DNA, 1260 bp, Unknown
  Obtained from environmental sample
atggcgcaacggattgaggaggccgaggttctggtgctcggcgccggcatcgtcggcgtctccatcgccctgcatctgcaaatgcgcggccgcgccacgctgctgctcgaccgtcaggggccgggggagggcacctccttcggcaatgccgggctcatccagcgagaggcagtgtttccgcatctctttccccgtcatccgggggacctgctgcggtatgccttcaatctcaagaccgaagcgcattatcaggcgcggatgctgccgcagctcgcgcggcccttcgcccgctactggtaccattccgagccgcgccgctacctggccctgtcccgccattacgagcggctcatcgcccattgcgtgagcgatcatcaggcgctggcggaggctgccggcgcgatggatctcctccgccccggcggctggaccatggtgcaccggacggcacgcagctttgcccacacgctgaaggaagcggagctcgcgaagcgagaattcggcgtggactatgccgtttgggatgcggctgaactcgcccggcaggagccgcatctggcccaaggtctcgccggcggcctgcattggacgcagccggtggcggtgctcgatccccatgccctgaccctcgcctatacggcgctgttcgagcgcctgggcgggcgggtgatgcgcgccgacgcccggcacctcgagcggccgggcggcgcctgggaggtggcggcgcctggggtggtggtgcgcgcgcctgcggcggtcgtggcactcggcgcctggtccccagaggtgacgaagccgctcggctacgatccgccgctcttcatcaagcgcggctatcacatgcactatcagcccgccggtaatgcgggcttggcgcatccggtcttcgatgtgtcggccggctacatgctggcgcccatgcgccgtggcatccgcctcaccaccggcgcgcaattcgtcgaccgcgatgcaccgcccaatcccgtccagctcgaccgggtggagcctctggcgcgccatctgctgcctggcctaggcaaccgattggacgacgcaccctggttcggtgcgcggccctgcacgcccgacatgctgcccatcatcggcccggcacccaggcagccgggcctctggttcggcttcggccacgggcatcagggcctcacgctcggccccaccacgggccgcatgctggccgccatgatggcgggagacgcgcccttcacagaccctgcgcccttccgccctgagcgattttga

SEQ ID NO: 426 - protein, 419 aa, Unknown
  Obtained from environmental sample
  DOMAIN (9)...(401): FAD dependent oxidoreductase
MAQRIEEAEVLVLGAGIVGVSIALHLQMRGRATLLLDRQGPGEGTSFGNAGLIQREAVFPHLFPRHPGDLLRYAFNLKTEAHYQARMLPQLARPFARYWYHSEPRRYLALSRHYERLIAHCVSDHQALAEAAGAMDLLRPGGWTMVHRTARSFAHTLKEAELAKREFGVDYAVWDAAELARQEPHLAQGLAGGLHWTQPVAVLDPHALTLAYTALFERLGGRVMRADARHLERPGGAWEVAAPGVVVRAPAAVVALGAWSPEVTKPLGYDPPLFIKRGYHMHYQPAGNAGLAHPVFDVSAGYMLAPMRRGIRLTTGAQFVDRDAPPNPVQLDRVEPLARHLLPGLGNRLDDAPWFGARPCTPDMLPIIGPAPRQPGLWFGFGHGHQGLTLGPTTGRMLAAMMAGDAPFTDPAPFRPERF

SEQ ID NO: 427 - DNA, 1254 bp, Unknown
  Obtained from environmental sample
atggcggaactgaaggccgacgtactcgttctgggtgcgggcatggttggcgtgagcgtcgccttgcacctgcagaagcgcggccgcggcgtggttctgatcgaccggcacgaggtcgccggtgaggaaaccagttacggcaatggcgggttgatcgagtgcgcctcggttttcccctacatgtttccacgcgacctcggccagatcctgcgctacgcgtttcttcgtgcgccgcaggtgcagtaccatttcagggatctgcccgtcttcctgccgtggctgacaaagtatttcctcgcctcgtcgccgcagcgcgcgctgaacagcgcgatggccgaactgccgctgatccagcgcagcctgatcgagcatgaagcgctgatcgcggaagccaatgtgcccgagcttttgcgccggatcggctggatcaagctgttccgttccgagaaaacgcttgcggctgcgatgggcgagttgaagcgggccgggcagtatggcgtcaccggtgacatcctggatacggccgcgatcctggcgcgcgagccgcatctgaccggggatttcagcggcgccatccattttccggcgccgggcttcgtgccggaccccggcggcttggccaaggcctattcggcgctgttcggccgcaagggcgggcggtatctcgtcggcgatgcgcgcacgctcgaacagtccggcacccgctggcgggtggcgacgatggaaggcaccatcacggcgcgggacgtcgtggtggcgatgggaccctggtcggaccagattttcgcgccgctcggctattcgatcccgctacaggtcaagcgtggttaccatttgcacctcaagccgcgcggcaacgcggtcctgaatcatcccgtgctggacaccgatctcggctatctgctggcgccgatgaaccgcggcattcgcctgaccaccggcgccgagtttgcccaccgcgacgcgccgccgacgccggtccaggtcgagcgttccctgccaagggcgcaccggctgttcccgctgggcgagccagtcgataccaagccctggatgggggcgcggccctgtttgcccgatatgctgccggtgatcggcaaggcgccccgccatagcgggctgtggttcgatttcggccaccagcaccacggtctgacgctcgggcccgcgaccggccgcctgctggccgagatgatgaccggcgagaccccgtttgccgatcacaggccctttgccgtcgaacgttttggttga

SEQ ID NO: 428 - protein, 417 aa, Unknown
  Obtained from environmental sample
  DOMAIN (7)...(398): FAD dependent oxidoreductase
MAELKADVLVLGAGMVGVSVALHLQKRGRGVVLIDRHEVAGEETSYGNGGLIECASVFPYMFPRDLGQILRYAFLRAPQVQYHFRDLPVFLPWLTKYFLASSPQRALNSAMAELPLIQRSLIEHEALIAEANVPELLRRIGWIKLFRSEKTLAAAMGELKRAGQYGVTGDILDTAAILAREPHLTGDFSGAIHFPAPGFVPDPGGLAKAYSALFGRKGGRYLVGDARTLEQSGTRWRVATMEGTITARDVVVAMGPWSDQIFAPLGYSIPLQVKRGYHLHLKPRGNAVLNHPVLDTDLGYLLAPMNRGIRLTTGAEFAHRDAPPTPVQVERSLPRAHRLFPLGEPVDTKPWMGARPCLPDMLPVIGKAPRHSGLWFDFGHQHHGLTLGPATGRLLAEMMTGETPFADHRPFAVERFG

SEQ ID NO: 429 - DNA, 1263 bp, Unknown
  Obtained from environmental sample
atgaacgaaccaaacaacaatttcgacgtaatcataatcggcggcggggtgattggcctttgctgtgcttattatttgaataaggcgggctgtcgggtggcactgctggagaagggcgacctgggcagcggcagttcgagcggtaatgcggggctgattgtgcctagtcattttattccgctggcggcgccgggggtggtggggcaagggttgaagtggatgctcgacccggaaagccctttttacatcaagcctcggctgaatggggatctgctgcgctggctgtggcagtttcggcgagcgagtacgcaagcgcatgttgagcggagtatgccgctgctgctggagatgcatttagccagtttggctttgtatgagcagttggcaggcgagttggattttgggttggtgcaggaggggctgttgatgttgtacaaaacggccgttggtgaagccgaatgtactgaactggttgaaaccgcccatcaactagatttagcggcagaattgttcgacgcggcgcaggtgggcgcgatgctgtctgggctggacgtgacggtggcgggtggcgcgtattttcctcgggatggacatttaaacccagggcagttattggctggattgcgtgaggttttggtgcaagctggcgtggcaatttttacgcagactgaggtattgggcttggtggcgaatggggaaaggatagccagcgtttctactacaaaaggcatgtttacggctgatgagattgtattggcaggtggctcctggtcgccgaatgtggtgcgggatttgggggtgcgtttgcccattcaagcggccaaagggtacagcttcatggcaccgcagttggcgggcaaactgactgtgccgctgctgctcacggatgccaaggtggcggtgacgccgttggcggagggcattcgctttgcggggacgttggagatgacggggctggatgtggcggtcaaccagcggcgggtggcggcgatgcgccgcgcggtgcctgattatttgccggcgtttgcgttggcggaggaaccgattagcgagatgggtgtgtgggctggtttacgcccctgttcaccggatggcttgcccatcattgggcgggatacaaacgttagcaacctgattctggcgacgggccatgccatgatgggggtttcattggcgccgattacgggcaagttggtggctgagattgtggcgggggaagcgagttcgattgaattgggaatgttagcgaaaaacaggttttga

SEQ ID NO: 430 - protein, 420 aa, Unknown
  Obtained from environmental sample
  DOMAIN (9)...(402): FAD dependent oxidoreductase
  SITE (379)...(382): N-glycosylation site. Prosite id = PS00001
MNEPNNNFDVIIIGGGVIGLCCAYYLNKAGCRVALLEKGDLGSGSSSGNAGLIVPSHFIPLAAPGVVGQGLKWMLDPESPFYIKPRLNGDLLRWLWQFRRASTQAHVERSMPLLLEMHLASLALYEQLAGELDFGLVQEGLLMLYKTAVGEAECTELVETAHQLDLAAELFDAAQVGAMLSGLDVTVAGGAYFPRDGHLNPGQLLAGLREVLVQAGVAIFTQTEVLGLVANGERIASVSTTKGMFTADEIVLAGGSWSPNVVRDLGVRLPIQAAKGYSFMAPQLAGKLTVPLLLTDAKVAVTPLAEGIRFAGTLEMTGLDVAVNQRRVAAMRRAVPDYLPAFALAEEPISEMGVWAGLRPCSPDGLPIIGRDTNVSNLILATGHAMMGVSLAPITGKLVAEIVAGEASSIELGMLAKNRF

SEQ ID NO: 431 - DNA, 1242 bp, Unknown
  Obtained from environmental sample
atgagaattggaatcatcggaggaggagtcataggactgtcatcggcttactacctgatgaaggcaggtcatcaggttacggttattgatcaatccggtctgcaggatggatgttcattcggcaatgcaggcatgattgtgccaagccacatcatcccgctggcttcaccgggaatgattgccaagggaattcgctggatgttcaactcaacgagtccgttttatgtgaagccacgcctgagtggcgacctgatcaaatggggctggcaattctacaagcactccacaaaatcgcatattgatcatgctgctcctgcattgaaggaaatcagcctgttgagcaaatctctttaccgcgaattggcgcgggagcttcccttcggtttcggctaccatgagcgaggactgctcatgctctatcagtcaaaggaaacggaacaagaagaaacagaaggcgcagcgtatgcaaacaaactaggcattgaagcgcatgtcctttcaccggatgaagtgcagcaacttgagcccgacatgaaggtgagtgtgcggggcggaatcttttacccgggcgatgcacatatcacaccgcatgcatttgtctctcaaatgctggattatcttcgggaaaaaggagttatcatcaagccagatactaccgttgtagattttgtgactgaaaactcaaagatcacccgggtgatcacggatcagggagattttacttttgatgaggtggtaattgcgaccggctcctggtcgggaatagtggcttcaaaacttggcatgaccttgccaatgcaggcaggtaagggatacagttttacgttacagaatgtcagaaaaaattcaagaataccttccatttttctggaagcccgtgtggcagtcacgccaatgggaacatccttacgcttcgggggcaccatggaaatcacaggaattgatcatgcaatcaacatgaaccgcgtcaggggaattgtagagtccatacccaggtattatcccgaactacgcgttgacattcccaaaaaggaagaggtatggcacggactgcgcccctgttcaccggacggattgccgtatatcggccgttcaaaaagattctcaaacctggttatcgcaaccggtcactccatgatgggactcagtctcggtccgggaaccggcaagctggtgagtgaattgattggtcgtgagaaatcaagcattgatatctctgcttttgatccggacaggttttaa

SEQ ID NO: 432 - protein, 413 aa, Unknown
  Obtained from environmental sample
  DOMAIN (2)...(395): FAD dependent oxidoreductase
  SITE (70)...(73): N-glycosylation site. Prosite id = PS00001
MRIGIIGGGVIGLSSAYYLMKAGHQVTVIDQSGLQDGCSFGNAGMIVPSHIIPLASPGMIAKGIRWMFNSTSPFYVKPRLSGDLIKWGWQFYKHSTKSHIDHAAPALKEISLLSKSLYRELARELPFGFGYHERGLLMLYQSKETEQEETEGAAYANKLGIEAHVLSPDEVQQLEPDMKVSVRGGIFYPGDAHITPHAFVSQMLDYLREKGVIIKPDTTVVDFVTENSKITRVITDQGDFTFDEVVIATGSWSGIVASKLGMTLPMQAGKGYSFTLQNVRKNSRIPSIFLEARVAVTPMGTSLRFGGTMEITGIDHAINMNRVRGIVESIPRYYPELRVDIPKKEEVWHGLRPCSPDGLPYIGRSKRFSNLVIATGHSMMGLSLGPGTGKLVSELIGREKSSIDISAFDPDRF

SEQ ID NO: 433 - DNA, 1245 bp, Unknown
  Obtained from environmental sample
atggcacgtactgatgcaatgattctcggtgccggtatcgttggcacttcgatcgcacttcatctcgccaagcgcgggctcagcgtggcgctggtcgaccgggccggcatcggcgagcagacgtcctatggcaatgccgggatcatcgagggcaacacaatatttccgcccgcatttccgtccagtgtcggcgcgctattgcgcgttgcgttcaagcgtgcaaccgaggccaactatcacctttcttttctgccgaaagttaccccttggctgctggcattccgcgcggcttcccgaccggaaaagctggccgagacggctcagctgatccgtccgctgttttcccgcgcggtcgccgaacacgaagcgctgatggctgaagcgggcgcgacgaaatatctacgcaagaccgggtggctcaaggtctatcgtgacgaaaagagcttcaagtcactcgctgccgagttcgacctggccgccaagttcggtttgccgctccaagctctcgatacagcaggcgcacaggcgctcgaaccgtctctcagtccggtcttcgcgcacggagtattctggccgcaggcggcaagcatcagcaatccgctcggcgttacgcgagcctatgcggcgcattttgcccggctcggcggtgtcttcctgaccggtgatgcgcagacactgcaccgttccggcagtaattggagggtagagacggatcagggcgcgcttgatgcaagtcagtgcgtgatcgcgctcggtccctgggcttcagatctgttgcggcagctaggcatcacgctgccgctcgctgtcaagcgcggttaccaccggcatttccatgcgcagggcaacgcggggctggcgcgcccggtgctggacgccaacgtggggtacctgatcacgccgatggagcaggggatccgtatgacgaccggcgccgagttcgccgcgcgtgacgctcaaccttcgccggtgcagtttgaccgtatcatgccgcaagcccggcaactgttcccgttcggcgaacgagcagacgatagaacctggatgggcagccggccctgcttgcccgactcccggcccgtgatcggccgcgcgcctaggctttccggactatggcttgcggtcggacatgcgcattggggcctaacgcttggcccggcgaccggccgtctcgttgcggaaatgatgacgggggatacaccgttttgtgatccaaccccgtaccgtgccgaacgatttagctag

SEQ ID NO: 434 - protein, 414 aa, Unknown
  Obtained from environmental sample
  DOMAIN (5)...(395): FAD dependent oxidoreductase
  SITE (368)...(380): Lipocalin signature. Prosite id = PS00213
MARTDAMILGAGIVGTSIALHLAKRGLSVALVDRAGIGEQTSYGNAGIIEGNTIFPPAFPSSVGALLRVAFKRATEANYHLSFLPKVTPWLLAFRAASRPEKLAETAQLIRPLFSRAVAEHEALMAEAGATKYLRKTGWLKVYRDEKSFKSLAAEFDLAAKFGLPLQALDTAGAQALEPSLSPVFAHGVFWPQAASISNPLGVTRAYAAHFARLGGVFLTGDAQTLHRSGSNWRVETDQGALDASQCVIALGPWASDLLRQLGITLPLAVKRGYHRHFHAQGNAGLARPVLDANVGYLITPMEQGIRMTTGAEFAARDAQPSPVQFDRIMPQARQLFPFGERADDRTWMGSRPCLPDSRPVIGRAPRLSGLWLAVGHAHWGLTLGPATGRLVAEMMTGDTPFCDPTPYRAERFS

SEQ ID NO: 435 - DNA, 1254 bp, Unknown
  Obtained from environmental sample
atgccaggaaccgttgacgccattgtgcttggcgccggaattgtcggcgtctcggcggcgctcgcgcttgctgagcgcgggcgagcggttgctctgatcgaccgcctgccccacgcggcgggcgagacgagcttcggaaacagcggcatcgttcagaccgagggcgttctcccttacctgttcccgcgcgcaattggcgacatcgccagggcggcgatgaaccgcgatcctcgcgcccatatccgctatggcgcgctgccctcgaccgcgccggcgatctggcgctatttccaggcctcgacgcaagcgagaaagctcgcgaccggcgcaatcatggcgccgctcatggcggcggccgccggcgagcacctgaagttcgctcgagacgccggcgccccggagctcctgcgcccgggcggctggatcaaggcctatcgcagcgagcgcgggcgggagctcgcgcatgacgaggccgaggagctgaagcgcttcggaatcaagcccgcgttcctcgaccgggcgaggctaaccgcgctcgagccgcatgtcggcgagaaggtgatcggcggcgtgcattatacggagccgctgtccacgcccgatccgggcgcgctcatccggagctatgccgcgctgttcctgaagcgcggcggccggatggagaggggcgaggcgctcagcctcgaggcctcgggcgcgggctggacggtcaagaccgattccggtgccctcgccgcccgcgatgtcgtcatcgcgctcgggccgtggtcggaccagctggcgaggcgcttcggcctctcgctccccttcttcgtcaagcgcggctatcacatgcactacgaagccagcggcaatgcggggctcggccgtccggtgctcgatctcgagcggggctatctcgtcaccccgatggctcagggcctgcggctgaccacgggggcggaattcgcccggcgcgacgacccgccgtcggctgcgcatctcgatcggctggagccattcgcgcgggagttgttcccgatcggcgcccggaaggaccccgcgccctggctcggccggcgcccctgcctgcccgacatgcgcccgatcatcgggccgttccccggcaagccgggcctgtggctcgacttcggccaccaccatttggggctcacgctcggccccatcaccgggcggcttctggcggaaatgatctgcggcgaagcgccgcttgtcgatcccgccccgttcaaggcggagcggttcgccgcctga

SEQ ID NO: 436 - protein, 417 aa, Unknown
  Obtained from environmental sample
  DOMAIN (6)...(397): FAD dependent oxidoreductase
MPGTVDAIVLGAGIVGVSAALALAERGRAVALIDRLPHAAGETSFGNSGIVQTEGVLPYLFPRAIGDIARAAMNRDPRAHIRYGALPSTAPAIWRYFQASTQARKLATGAIMAPLMAAAAGEHLKFARDAGAPELLRPGGWIKAYRSERGRELAHDEAEELKRFGIKPAFLDRARLTALEPHVGEKVIGGVHYTEPLSTPDPGALIRSYAALFLKRGGRMERGEALSLEASGAGWTVKTDSGALAARDVVIALGPWSDQLARRFGLSLPFFVKRGYHMHYEASGNAGLGRPVLDLERGYLVTPMAQGLRLTTGAEFARRDDPPSAAHLDRLEPFARELFPIGARKDPAPWLGRRPCLPDMRPIIGPFPGKPGLWLDFGHHHLGLTLGPITGRLLAEMICGEAPLVDPAPFKAERFAA

SEQ ID NO: 437 - DNA, 453 bp, Unknown
  Obtained from environmental sample
atggaactggcagacgaaatcaccatcaatgcgccaaaggacgttgtctacgcggctctgaacgaccctgatatcctccaacaatgcatcccgggttgcgaagagttggtcaagcattccgacaccgaacttgaggccaaggtcgtcctgaaagtcggaccggtgaaagcgcgtttcagcggcaatgttgagttgaacacagatggggcgccggacgcgttttccctttcaggccaaggcaacggcggggcggcgggacacgccaagggcggagcggatgtcacgcttactgctgatggcgacacgaccatactcaaatacgaggcgaaggccgagatcggaggcaagctcgcgcagttgggcagccggttgatacagagcacggccaagaagctagctgccaagttctttggttcctttgcagaggcaatggagaatcagtcggtagcttag

SEQ ID NO: 438 - protein, 150 aa, Unknown
  Obtained from environmental sample
  DOMAIN (5)...(145): Carbon monoxide dehydrogenase subunit G (CoxG)
  SITE (148)...(151): N-glycosylation site. Prosite id = PS00001
MELADEITINAPKDVVYAALNDPDILQQCIPGCEELVKHSDTELEAKVVLKVGPVKARFSGNVELNTDGAPDAFSLSGQGNGGAAGHAKGGADVTLTADGDTTILKYEAKAEIGGKLAQLGSRLIQSTAKKLAAKFFGSFAEAMENQSVA

SEQ ID NO: 439 - DNA, 780 bp, Unknown
  Obtained from environmental sample
atgacccccgccgagatcatcgaaccagaactttcgcaagcggcccgggacctgcgggaccgggatgagccgttttgcttcgcaaccatcgtgcgcacggtcggtgcaacggcggccaagcccggggcgaaggctttgctggcggcggacggaacgatcctcgagggctgggtgggcggcggttgcgccagaggtgccgttaaaagggcagcggcgctggcactcagcacaggcgatccgcaactgatctcggtcgctccggaagaattcctcgccgagatcggggtggaacctggaaccgaacaggacggcgtcacctatgcgcggaatggctgcccatccaagggcactgtcgatattttcgttgagccctgcctgcccataccggaactgatcattcttggcgggtcgccagtggccaaagcactaacccaacttgccccacagtttcattgggcggtgacagcaagttcggacggggccaatctgaccgaaaccaatcggcgccgcttcgtcgttgtcgcgacgcaagggctgggggatctggccgcgctaagggctgcttcggaagtgaaggcggaccatgtctgttttgtaggaagcagtcgaaagttcgccgcgctctcggaacagctggttgaggaaggggcggcgccttccaagctcgctcgcatcaaggcgccagccggcctcgacatcaaagctgtgacaccggaggaaatcgccctctcgatcctcgccgaactcgtccaggtgcgtcggggcgcggtccagtcatga

SEQ ID NO: 440 - protein, 259 aa, Unknown
  Obtained from environmental sample
  DOMAIN (16)...(88): XdhC and CoxI family
  SITE (164)...(167): N-glycosylation site. Prosite id = PS00001
MTPAEIIEPELSQAARDLRDRDEPFCFATIVRTVGATAAKPGAKALLAADGTILEGWVGGGCARGAVKRAAALALSTGDPQLISVAPEEFLAEIGVEPGTEQDGVTYARNGCPSKGTVDIFVEPCLPIPELIILGGSPVAKALTQLAPQFHWAVTASSDGANLTETNRRRFVVVATQGLGDLAALRAASEVKADHVCFVGSSRKFAALSEQLVEEGAAPSKLARIKAPAGLDIKAVTPEEIALSILAELVQVRRGAVQS

SEQ ID NO: 441 - DNA, 1182 bp, Unknown
  Obtained from environmental sample
atgagccgggtgacccgttttgctgcccgtgatcccgggcctgccgcgcgtctctctggcttcgtggcccatctccgagacaacggattgcgtctgggtgtgtccgagacagcacttgcgcttgacgccctgggggcgatggatgccttcacctctgatgattgccgccgcgcgctccgtcccatctgcaccggttgtaaagaagaagtggatcagttcgatgcgctcttcgacgcctactggcttgatgcaggtcgagtcaggacacgcgtgatgccgacgcatgtaccaagcgcgagcgatcatgtgcattcttcccgcgatgcagaaggcgaggcttcgggcggcacaggtacggcgacgatgccggacggtggtgatggcgagtccgaacgcgatggcgaaggcaagctcattgcgactgaggttcgcaacctgtcccgtcgcgatctccgcgatctggtgcggcctgaagagattgccgaggctgaggaagtcgcacgccgtctcggagctgccctccgcgaccgccgttcgcgacgacgcattgcggcccgcaagggtgatcggctgcatttccgcaagactatccggcgtagcctctcgacaggtggggaaccattgcacctcctgcgcaagaaacgtcccgaccggacccgcaagatcaccgcgatttgcgatgtgtcgggctccatgaccgtctacgcgcaggtgttccttgccttcatagcaggcctcatgcgcgccgatccgctggccgatgcctacctgttccacacccggcttgtgcggatcacagaaacgctccgcgacaaggacgccttgcgtgccatcggccgcatgtcccttatggcggacggtttcggcggaggctcgaagatcggcgaatgcctggatcgctttgcgcatacctatgccaggcgctttgtggacgggcgcagcgtcgtcctgatcctctcagacggctatgacacgggcaaaccggaagcgatgagtgtagcgcttggtcagttgcgcaaacgcggctgcaagatcatctggctgaatccgctcaagggctggcgcgactacgaacccgtaacagcgggcatggctgccgctttgccgcatctcgatctgttccgtgcggcgaataccctggacgatctcgcggcactggaaggggaactcacacggctatga

SEQ ID NO: 442 - protein, 393 aa, Unknown
  Obtained from environmental sample
  DOMAIN (147)...(383): VWA domain containing CoxE-like protein
  SITE (147)...(150): N-glycosylation site. Prosite id = PS00001
MSRVTRFAARDPGPAARLSGFVAHLRDNGLRLGVSETALALDALGAMDAFTSDDCRRALRPICTGCKEEVDQFDALFDAYWLDAGRVRTRVMPTHVPSASDHVHSSRDAEGEASGGTGTATMPDGGDGESERDGEGKLIATEVRNLSRRDLRDLVRPEEIAEAEEVARRLGAALRDRRSRRRIAARKGDRLHFRKTIRRSLSTGGEPLHLLRKKRPDRTRKITAICDVSGSMTVYAQVFLAFIAGLMRADPLADAYLFHTRLVRITETLRDKDALRAIGRMSLMADGFGGGSKIGECLDRFAHTYARRFVDGRSVVLILSDGYDTGKPEAMSVALGQLRKRGCKIIWLNPLKGWRDYEPVTAGMAAALPHLDLFRAANTLDDLAALEGELTRL

SEQ ID NO: 443 - DNA, 1272 bp, Unknown
  Obtained from environmental sample
atgccaagcaatcgaaccgacgtcgtcgtcctcggggccggcatcatcggcatctgcgtcgcgctgcaccttcagaagcgcgggcgtgcagtgacgctcctggatcggcgtggcgcagccgaggagacctcctacggaaacgccgggctgatccagcgcgaaggcgtctttccgtacggattcccgcacgacttcggcgcgctcctccgctacgggctgaatcgcacgatcgacgcgcactaccacgcgtccgcgctgccgcggctcgcgcccttcctgtggcagtactggcatcactcgcgccctgcgcggcatgccgaggtcgcgcgccgctacgcgaagctgatcgagcactgcgtggtggagcacgatgcgctcgcgcgcgaagcgggcgcagaagagttcatccggcgcgtgggctggatcaaggtgttccgcaccgcgcgggagcgcgaccggcgcttcgccgaggccgcgcgttggcatcgcgagttcgggctcaactaccgggcgatcgacgctcctgcgctgcaggagatggagccccatctcgcccccgcgctcgccggcgcgctgcactggaccgatccgaccagcgtcgacgatccgcaaggactggcacatgcctacctgcgtcacttcgagcgcctcggcggaaggttcgtgcagggcaacgccgcgagcctcgaggcgcagggcgcggggtggcgactgcgcaccgcgggaggcattctcgaggccggtgcggcggtgatcgcgctcggcccctgggcaggcgtgctgacgcgcgcgctcggctacgacctgccgctggcggtgaagcgcggctaccacatgcactaccgggccgcgggtgaagcgcgcctgaaccatccaaccctggatgccgagcgcggctactttctcgcgccaatgcgtcgcggcatccggctcaccacgggagcggagttcgcgctgcacgacgcaattcgaacgccggtgcagctcggtcgcgccgagccgatcgcgcgcgagctctttccgcttgccgagcgtctcgacaccgaggcctggatgggcgcgcgtccctgcacgccggacatgctgccggtgatcggcagggcgccgcgccacgcgagcctgtggttcgctttcggccatgcgcaccacggcctgacgctcggtccggtgaccggaaggctgatcgccgagctcgtcacgggcgaaacgccgttcgtcgatccggcgccgtattcggccgcgcgcttcgaaggcggcaaccgcgggcgttga

SEQ ID NO: 444 - protein, 423 aa, Unknown
  Obtained from environmental sample
  DOMAIN (7)...(398): FAD dependent oxidoreductase
  SITE (4)...(7): N-glycosylation site. Prosite id = PS00001
  SITE (75)...(78): N-glycosylation site. Prosite id = PS00001
MPSNRTDVVVLGAGIIGICVALHLQKRGRAVTLLDRRGAAEETSYGNAGLIQREGVFPYGFPHDFGALLRYGLNRTIDAHYHASALPRLAPFLWQYWHHSRPARHAEVARRYAKLIEHCVVEHDALAREAGAEEFIRRVGWIKVFRTARERDRRFAEAARWHREFGLNYRAIDAPALQEMEPHLAPALAGALHWTDPTSVDDPQGLAHAYLRHFERLGGRFVQGNAASLEAQGAGWRLRTAGGILEAGAAVIALGPWAGVLTRALGYDLPLAVKRGYHMHYRAAGEARLNHPTLDAERGYFLAPMRRGIRLTTGAEFALHDAIRTPVQLGRAEPIARELFPLAERLDTEAWMGARPCTPDMLPVIGRAPRHASLWFAFGHAHHGLTLGPVTGRLIAELVTGETPFVDPAPYSAARFEGGNRGR

SEQ ID NO: 445 - DNA, 1245 bp, Unknown
  Obtained from environmental sample
atgaagccaaccatcattgtaggaggagggataattggccttttcactgcatatttcctccaaaaagagggtattgaagtccagattattgacaaaggtgacatggaggtgaactgttccacaggtaatgccggaatgattgtacccagccatattattcctttggctgcaccggggatgatttccaaaggaatttcgtggatgttctcttccaaaagtccgttttatgttcacccaaggttagataggaaattaatcgaatggtcttggcttttttaccgttcggccaataaatcacatgtggaaaaatccattccctttctcaaaaatatcagtcttttaagtaaagccctttaccaacaatttaaggaagaacacaagggagcagatttccaaatggtagaaaagggattgatgatgctttaccaaacatcagaagtggaaaaagaggaagtagagtttgcacatttggccaatcaacatggcttgggtgcggaagtcctaaccccttctgatatccaaaaaatcgaacccaatcttgaggtaaaagccaaaggggcagttttgtttccaggggatgcccacttatctccagctgctttgtattcttttttgaaaaagtatttagaagagaaaggaattcaattccacagcaaagttaaagtaaccggtttccaaacccgctcaggaaaagtggaggcagtaatcactgaaaatggaagggtggagggagctcaatttattctttgcggaggggcttggtcagccgagttggctgccatgctcgggctgaaacttcctatgatgggaggcaaaggttacagctttattcaggagaataaaccggaaatcaaacaggcaagtattttgaccgagatgaaagtggctgtaagtccctatggcaagcaggtaaggtttggaggaaccatggaaattgccggaacggatgaaaaagtaaatatgaatcgtgtacgaggaatttttgaatccatcaacaggtattatccaagttttcaatcccaatttcccaaagaaggagaaatctggaaaggactaagaccctgttctccggatggcttgccatatattggtaaatctaaagtatggtcgaatgtgttgattggttccggccatgggatgatgggactgagtatggctcctgcaactggaaagatcctggcagacctccatgaagggcatgcttcaatgatggatttaaaggcttttgaggtggggaggttttaa

SEQ ID NO: 446 - protein, 414 aa, Unknown
  Obtained from environmental sample
  DOMAIN (3)...(396): FAD dependent oxidoreductase
  SITE (38)...(41): N-glycosylation site. Prosite id = PS00001
  SITE (98)...(101): N-glycosylation site. Prosite id = PS00001
  SITE (111)...(114): N-glycosylation site. Prosite id = PS00001
MKPTIIVGGGIIGLFTAYFLQKEGIEVQIIDKGDMEVNCSTGNAGMIVPSHIIPLAAPGMISKGISWMFSSKSPFYVHPRLDRKLIEWSWLFYRSANKSHVEKSIPFLKNISLLSKALYQQFKEEHKGADFQMVEKGLMMLYQTSEVEKEEVEFAHLANQHGLGAEVLTPSDIQKIEPNLEVKAKGAVLFPGDAHLSPAALYSFLKKYLEEKGIQFHSKVKVTGFQTRSGKVEAVITENGRVEGAQFILCGGAWSAELAAMLGLKLPMMGGKGYSFIQENKPEIKQASILTEMKVAVSPYGKQVRFGGTMEIAGTDEKVNMNRVRGIFESINRYYPSFQSQFPKEGEIWKGLRPCSPDGLPYIGKSKVWSNVLIGSGHGMMGLSMAPATGKILADLHEGHASMMDLKAFEVGRF

SEQ ID NO: 447 - DNA, 1308 bp, Unknown
  Obtained from environmental sample
atgcgtgttctgattctcggtagcggcgtgatcggcaccaccaccgcttggtatctgcgccaggccgggtgtgaggtgaccgtggtcgaccgtcaacccgggccggggctggaaaccagcttcgccaatgccggccagctctcgttcggctacacctcgccctgggcggcgccgggggtgccgaagaaggccatcggttggctgttcgagcagcacgcgccactggcgatccgtcccggcatggacctggcccagtacgcgtggctgtggcagatgctgcgcaactgcacccacgatcgctatgcgatcaacaaggcgcgcatggtgcgtctctcggaatacagccgcgactgcctgaaccagctgcgcgcggagaccggcatcgactacgaaggccgcgagctgggcacgacccagctgttccgcacccagcagcagctggatgcgtcggcgcaggacatcgaggtgctggcgcaatacggcgtgccctatgaagtcctggaccgcgacggcatcgtgcgtgccgaaccggcgctggcgcacgtggcccataccctggtgggcgcgttgcggctgccacgcgaccagaccggcgactgccagctgttcacccgccggctggcggcgatggcggccgaggtcggcgtcgagttccgctacgaacaggacatcacctcgttgcagcgcgacggcgaccgcatcaccggtgtgcgcatcggcggccggctggaaaccgcggaccactacgtggtggcgctgggcagttactcgccggcgctggtggcaccgctggggctgcgcctgccggtgtacccgctgaagggctattcgctgaccctgcccatcgtcgacccggccatggcgccgacctcgaccatcctggacgagagcttcaaggtggcggtcacccgcttcgacagccgcatccgcgtgggtggcatggccgaagtggccggtttcgacctgtcgctgtcgccgcgccgccgcgccaccctggagcgcgtggtctgcgacctctacccgaagggcggcgacctggggcgcgccgaattctggaccggtctgcgcccggccacgccggacggcacccccgtggtaggcgccaccccgctgcgcaacctgttcctcaacaccgggcacggcacgctgggctggaccatggcctgcgggtcgggccgctatctggccgacgtgatgtgcgcgcgccagccgcagatcagcagcgaaggcctggatatcttccgctatggccaccgccgccccgccgccccgatggagagccgcgcatgcgcccagcccgcgcgctga

SEQ ID NO: 448 - protein, 435 aa, Unknown
  Obtained from environmental sample
  DOMAIN (2)...(398): FAD dependent oxidoreductase
  SITE (96)...(99): N-glycosylation site. Prosite id = PS00001
MRVLILGSGVIGTTTAWYLRQAGCEVTVVDRQPGPGLETSFANAGQLSFGYTSPWAAPGVPKKAIGWLFEQHAPLAIRPGMDLAQYAWLWQMLRNCTHDRYAINKARMVRLSEYSRDCLNQLRAETGIDYEGRELGTTQLFRTQQQLDASAQDIEVLAQYGVPYEVLDRDGIVRAEPALAHVAHTLVGALRLPRDQTGDCQLFTRRLAAMAAEVGVEFRYEQDITSLQRDGDRITGVRIGGRLETADHYVVALGSYSPALVAPLGLRLPVYPLKGYSLTLPIVDPAMAPTSTILDESFKVAVTRFDSRIRVGGMAEVAGFDLSLSPRRRATLERVVCDLYPKGGDLGRAEFWTGLRPATPDGTPVVGATPLRNLFLNTGHGTLGWTMACGSGRYLADVMCARQPQISSEGLDIFRYGHRRPAAPMESRACAQPAR

SEQ ID NO: 449 - DNA, 1248 bp, Unknown
  Obtained from environmental sample
atgaagcgtgatgtgatcgttctcggcgccggcatggtcggcgtgggctgtgcgctgcacctgcaggccaggggcctgtcggtcgcgttgctggaccgccgcgcgcccgggcttgaaacctcgtacggcaacgccggcatcatccagcgcgaagccatcgggccttatgcgctggaccgcgacctgggctttctgctctcgggcatgaccaaccggcgcgtcgacgtgcgttaccacctcggcgatgccgcccggctgctcgggccgctgtggtcctactaccagaactcggcgcccgacgcgtaccagaagatcgccgccgagtacgagaccctcatcgcgcactcgctcgacacgcacgggcaactgatgcgcgacgcccatgccgaacacctggtgggcgggcatggttacctcgcgctctaccgctccgagcgcgacctgcacgagctcttcaaggtggccgacgagcgcgcgctcaagggcgtgcaccacgtcaagctcagcggcgccgacgtggcgcaggccgagccctcgctcgtgggcgacttcgccggcgcggtgcgctggaccgacccgctggccatcagcagcccgggggatctggtgcaggcctacgcgcggctgttcgcgcaacggcgcggcacgctgcacgtgggcgatgcgatggcgctgcgccgcaccgatgcgggccattggcaggtggacgcggccgacgacgtgctcgaagcgccccgcgtggtggtggcgctcgggccgtggaccaccgagctgaccgcgcgctatggctacaccgcgcccgtgattcccaagcgcggctaccacgtgcactacatgcgggtgccgctccagccgctcaacagcaccgtgatcgatggcgaccacggcttcgtggtcgcgcccatgaaggacggcctgcgcctgaccaccggcgccgaactcgcgatgcccgacgccccgcgcacgccgacgcagatcgaggcggccgagaagatcgcccggctcgtctacccgctcggtgagcgcgtggagcccgagccctggatgggcacgcgcccctgcatgcccgacatgaaaccggtgttcggcgcggtgcccgacgtgcccggcatgtggtgcgccttcgggcatgggcaccaggggttcacgctcgggcccatcaccggcgagttgctcgccgccatggtgacgggcgcaccaccgcgggtggacgtgcggccgttttcgccggagcggttcgggcggtag

SEQ ID NO: 450 - protein, 415 aa, Unknown
  Obtained from environmental sample
  SIGNAL (1)...(23)
  DOMAIN (4)...(395): FAD dependent oxidoreductase
  SITE (291)...(294): N-glycosylation site. Prosite id = PS00001
MKRDVIVLGAGMVGVGCALHLQARGLSVALLDRRAPGLETSYGNAGIIQREAIGPYALDRDLGFLLSGMTNRRVDVRYHLGDAARLLGPLWSYYQNSAPDAYQKIAAEYETLIAHSLDTHGQLMRDAHAEHLVGGHGYLALYRSERDLHELFKVADERALKGVHHVKLSGADVAQAEPSLVGDFAGAVRWTDPLAISSPGDLVQAYARLFAQRRGTLHVGDAMALRRTDAGHWQVDAADDVLEAPRVVVALGPWTTELTARYGYTAPVIPKRGYHVHYMRVPLQPLNSTVIDGDHGFVVAPMKDGLRLTTGAELAMPDAPRTPTQIEAAEKIARLVYPLGERVEPEPWMGTRPCMPDMKPVFGAVPDVPGMWCAFGHGHQGFTLGPITGELLAAMVTGAPPRVDVRPFSPERFGR

SEQ ID NO: 451 - DNA, 1245 bp, Unknown
  Obtained from environmental sample
atgaagccggacatcgtggttctcggcgccggcatggtcggcgtctgcgtcgcgctgcacctgcagaagcgcgggcgcggcgtggtgctgatcgatcggcgcggcgtggccgaggagacttcgttcggcaatgccggcatcatccagcgtgaggcggtctccccgcatccctttccgcaggacctcgccacgctcctgcgctacggctcgaaccgttccatcgatgcctgctaccaccttgcagcgctgccgtacatcgcgtctttcctttggcagtggcggcgccactcgcaggcggagcggcatgccgagatcacgcggcattacgcgcgcctgatcgaacattgcaccgccgagcacgatgcgcttgccgcggcggcaggcgcggccgatctgctgcgtcgggacggatggatccgcgtgtaccgttccacggagaaattcgccgcaggcctggccgacgccgagcacctccagcgcacgtacggtgtcgcgtttcgtgcgttggatccacaggccctgaagcaagctgagccgcatctcgcgccggtgctctccggcggcttgcattggacgcagccgatcaccgtgggcaacccgcaggccctcgcagcggcctacctgcggcacttcgaaacgctcggcggacgcttcgtgcaaggcgacgcagcgacactgcgcgcggtcggcacgggttgggggatcagcactgcgcagggaccgattgaggcgtccgacgcggtcattgcgctcggaccctgggccgacgtcgtcacgcgcaagctgggctacaacctgccgctcgcagtgaagcgcggatatcacatgcactatcgcaccgcggacggcgcaaggctcaaccatcccgtggtcgacagcgaaacagggtactgcctcgcgcccatggcgcgcggcatccgtctgacgacgggcgccgagttcgcgcggcgcgacgccattcgcacacccgtgcagctcgctcgtgccgaaccgatcgcgcgcaagctgttcccgctcgccgaacgagtggacgacgagccctggatgggcgcgcgtccctgcacgccggacatgctgccgatcatcggccgggccacgcgccaccgcaatctctggttcacgttcggccacgcgcaccaggggttcacgctgggtgccgtgaccgggcggttgatcgccgagatgctcactggagaggagcccctggtggacccggcgccatatcggccggatcgattctcctga

SEQ ID NO: 452 - protein, 414 aa, Unknown
  Obtained from environmental sample
  DOMAIN (4)...(395): FAD dependent oxidoreductase
  SITE (72)...(75): N-glycosylation site. Prosite id = PS00001
MKPDIVVLGAGMVGVCVALHLQKRGRGVVLIDRRGVAEETSFGNAGIIQREAVSPHPFPQDLATLLRYGSNRSIDACYHLAALPYIASFLWQWRRHSQAERHAEITRHYARLIEHCTAEHDALAAAAGAADLLRRDGWIRVYRSTEKFAAGLADAEHLQRTYGVAFRALDPQALKQAEPHLAPVLSGGLHWTQPITVGNPQALAAAYLRHFETLGGRFVQGDAATLRAVGTGWGISTAQGPIEASDAVIALGPWADVVTRKLGYNLPLAVKRGYHMHYRTADGARLNHPVVDSETGYCLAPMARGIRLTTGAEFARRDAIRTPVQLARAEPIARKLFPLAERVDDEPWMGARPCTPDMLPIIGRATRHRNLWFTFGHAHQGFTLGAVTGRLIAEMLTGEEPLVDPAPYRPDRFS

SEQ ID NO: 453 - DNA, 1254 bp, Unknown
  Obtained from environmental sample
atggacgacgtcatcatcctgggcgcggggatcgtgggaatcgcgacggggattcacctgttgcggcgcgggcgcagcgtgacgctggtggaccgcaatgcgccgggccgcgaaaccagtttcggcaatgccgggatcatccagcgcgaaggcgtgcgcccgcatgcctttccgcgcgacctgcagacgctgctgcaggtggggctgcacctgtccaccgcagcgcgctattcgccgctggcgctgccgaagctggcgccgccgctgctgaaatattggtgggaatcctcgcccgagcattatcgcaaagtggtgcaatcctatgcgccgctgatcgggcgctccatcctcacccataacgacttcatcatggcggtggggccggacgcggagaagctgatttcgcgctatggctggcacctggccttccgcagccaggacaagttcgagcgggaaatcgccaaggccgagggcgaccacgcgcaattcggcatcggctatcgcgcgctggactggcccgcgttaaaggccgccgagccaaacctgatcggcgggctggtgggggccatccactggaccgatccctggacggtacgcgacccgggcgctttggtatccgcctatttcgggctgttcgaaaagctgggcggcacgttcgtcagcggcgcggccagcgggttggtgccggaggcggatggctggagcagcatggtcgatgggcagaagctgatggcccggcaggcggtgatcgcgctcgggccctgggcgccggacgtgctggagccgctgggctatcgcctgccgcttttcgtcaagcgcggctatcacatgcattatagcgcgcaggagggcgctgaactcaagcacctgctgctcgacccggaagtgggctatgccatggcgccgatggcagcgggcatccgcatcaccaccggcgccgaattttcgctgcgcgatgccaagccgaccccgatccagctcgccaaggcggagaaggcggcgcgcgagctgttcccgctgggtgaacggcgcgacccgcagccctggaagggcgcccgcccctgcacgcccgacatgatgccgatcatttccaaagcgccccggcacgaggggctttatgtggggatcggccacgcccatcacggctttacgctgggcccggcgacgggcgaattgctggcgcagacgatgacgggggaagagacggccatcgatatcaaaccgttccggatggagcggtttctgggagggtga

SEQ ID NO: 454 - protein, 417 aa, Unknown
  Obtained from environmental sample
  DOMAIN (3)...(396): FAD dependent oxidoreductase
MDDVIILGAGIVGIATGIHLLRRGRSVTLVDRNAPGRETSFGNAGIIQREGVRPHAFPRDLQTLLQVGLHLSTAARYSPLALPKLAPPLLKYWWESSPEHYRKVVQSYAPLIGRSILTHNDFIMAVGPDAEKLISRYGWHLAFRSQDKFEREIAKAEGDHAQFGIGYRALDWPALKAAEPNLIGGLVGAIHWTDPWTVRDPGALVSAYFGLFEKLGGTFVSGAASGLVPEADGWSSMVDGQKLMARQAVIALGPWAPDVLEPLGYRLPLFVKRGYHMHYSAQEGAELKHLLLDPEVGYAMAPMAAGIRITTGAEFSLRDAKPTPIQLAKAEKAARELFPLGERRDPQPWKGARPCTPDMMPIISKAPRHEGLYVGIGHAHHGFTLGPATGELLAQTMTGEETAIDIKPFRMERFLGG

SEQ ID NO: 455 - DNA, 1242 bp, Unknown
  Obtained from environmental sample
atgaaagtaacaatagtaggagctggagtggttggattatgctgcgcttattacctggacaaagaaggtttcgacatcaccgtcattgatcgtaatgatataaccgatggatgttcgtttggaaacatgggttatatttcccccagccattttataccgctggcatcaccaggaattgtcagccagggtttgaagtggatgctgagttcatcttctcctttttatataaaaccgagattgaattgggaactgatgcaatgggggatgaccttctggaaaaactccaatgcgcaaaaagtgaaagccagtattccccatctcaataacttattgctgttaagccgtgatttaatgaatgacctgaagaaggaattcaatgattcttttagcatgatcgagagaggatgctggacgctttacaaaaatgaaaagaccggtgatcatgaaaaacacttaacggaacaggcaacaggcttgggtttgaaaacccaaacttataccgggacccaagtacaggaaatggaaagtgaagtggaagtaaatgtggccggtggtgtattgtggctcgacgattgtcatttggactctgcaaaactgatgcggtcgttgcaccgttatttgcaggaaaagggtgtaaagtttcttctcaataccgaagtaaaaggctttgaaaggaccaacggaaaaataaattcggtgatcaccgataaagaaaaaataaatgctgatgaagtaattgttgccaatggttcatggatgcctgccgttgcgaggatggccggaattcacttgttgatgcaacccggcaaaggatatagcgtggtgtatgagaatatggaaaagaaccttcgtcggcccgcaatattggtagaagcacgcacggcgatgacgccgattgaacgctggctcaggataggagggacgatggaattaagtggacacagtgataatatcttgccgaagcgggtcaatgccatttacgaatccgtaaacaaatattttccttcattaaatatttcgcagcccgatccggcaaaggcatggtatggctacaggcctgtgacacctgatggcctgccctatattggaaagcataaaaaattcgcgaatctcacgttcgcgggtggtcatgcgatgctgggcgtatccgcagcggctgctaccggaaaattggtcaatgagatcatcggaaatcgacctacgtcgattgacatttttgcctttgagccggagagattttga

SEQ ID NO: 456 - protein, 413 aa, Unknown
  Obtained from environmental sample
  DOMAIN (2)...(395): FAD dependent oxidoreductase
  SITE (127)...(130): N-glycosylation site. Prosite id = PS00001
  SITE (252)...(255): N-glycosylation site. Prosite id = PS00001
  SITE (343)...(346): N-glycosylation site. Prosite id = PS00001
  SITE (375)...(378): N-glycosylation site. Prosite id = PS00001
MKVTIVGAGVVGLCCAYYLDKEGFDITVIDRNDITDGCSFGNMGYISPSHFIPLASPGIVSQGLKWMLSSSSPFYIKPRLNWELMQWGMTFWKNSNAQKVKASIPHLNNLLLLSRDLMNDLKKEFNDSFSMIERGCWTLYKNEKTGDHEKHLTEQATGLGLKTQTYTGTQVQEMESEVEVNVAGGVLWLDDCHLDSAKLMRSLHRYLQEKGVKFLLNTEVKGFERTNGKINSVITDKEKINADEVIVANGSWMPAVARMAGIHLLMQPGKGYSVVYENMEKNLRRPAILVEARTAMTPIERWLRIGGTMELSGHSDNILPKRVNAIYESVNKYFPSLNISQPDPAKAWYGYRPVTPDGLPYIGKHKKFANLTFAGGHAMLGVSAAAATGKLVNEIIGNRPTSIDIFAFEPERF

SEQ ID NO: 457 - DNA, 1251 bp, Unknown
  Obtained from environmental sample
atgggaaaaaacgttttgatcattggcggaggaatagtgggactctgctctgcatattttttacataaagaagggcatcaggtaaccgttttggataagtcggatattacttccggtgcctcttttgtcaacgctggatttattaccccaagccatattattccactggcctctccgggaatgattttaaaaggaattaaatggatgtttagtccaaccagtccgttttatatgcaacccagatgggatatcgacttttttaaatggtcctggtattttcataaatcttccacaaaggaaaaggttgcactggccattccgttaattaaagaaagtaacctaataagtagggaactttttacagccattaaaaattctggggatttagggaattttcagctggaacgaaagggcttattaatgttatataaaactgaggcagaaggggaacatgaaatgcaagtggcggaaaaagcttcctttttaggcctagaagtaagttacttggataagaatactttggataaattgcagccccaagtgagcatggatgttagaggggctattcattatgagtgtgatggacataccacaccaacagaattcatggagaaaatgctggattacctaagacgaagcggcgtaatcatcaagaccaaagaagaggttaaggatttattgataaataacaatcaaataaccaaggtaatcacagacaagtctgattattcagccgatgaaattgttttggcggcaggatcttggagcgagaaattatccaaaaaaatgaggctaaaactccccatacaggcgggcaagggatacagtataaacgtaccgcgcccaacagggattaccattcctgccattttaatggaagctaaggtagccgtgactcctatgaaggagtatacccgatttgcaggaacaatggagttttctggaataaacgaaatcattaaaaaacagcgagtggaggctatagccaaagcagtcactgaattttatccggacatcgaaattaacgacatggaaatagcgggtgcaaaaagtgggcttcgcccagtttctcctgatggcttaccatacattggcaaatgctcctccttaaaaaatttaaccattgccacaggacatgccatgatgggctggagtcttggaccggttacaggacaattggtctcggaaataatatcgaacaaaaaacctgttatggatattgctggcttttccccaaatagaaaattctag

SEQ ID NO: 458 - protein, 416 aa, Unknown
  Obtained from environmental sample
  DOMAIN (4)...(397): FAD dependent oxidoreductase
  SITE (377)...(380): N-glycosylation site. Prosite id = PS00001
MGKNVLIIGGGIVGLCSAYFLHKEGHQVTVLDKSDITSGASFVNAGFITPSHIIPLASPGMILKGIKWMFSPTSPFYMQPRWDIDFFKWSWYFHKSSTKEKVALAIPLIKESNLISRELFTAIKNSGDLGNFQLERKGLLMLYKTEAEGEHEMQVAEKASFLGLEVSYLDKNTLDKLQPQVSMDVRGAIHYECDGHTTPTEFMEKMLDYLRRSGVIIKTKEEVKDLLINNNQITKVITDKSDYSADEIVLAAGSWSEKLSKKMRLKLPIQAGKGYSINVPRPTGITIPAILMEAKVAVTPMKEYTRFAGTMEFSGINEIIKKQRVEAIAKAVTEFYPDIEINDMEIAGAKSGLRPVSPDGLPYIGKCSSLKNLTIATGHAMMGWSLGPVTGQLVSEIISNKKPVMDIAGFSPNRKF

SEQ ID NO: 459 - DNA, 1266 bp, Unknown
  Obtained from environmental sample
atgcaacgcattgccgttatcggtggcggtatcaccggcattaccagcgcctacgccctagccaaacgtggctatcaggtcaccgtctttgaaaaacatcgttacgccgccatggagacctcgttcgccaacggtggtcagctttcggcttcgaatgccgaagtgtggaaccactggccaaccgtaattaagggcatgcgctggatgctccgaaacgatgccccgctgctggtcaaccctcgccccagctggcacaagctcagttggtttggcgaatttatcgcctcgattccccgctactctgagaacactaccgagaccgcgcggctggcgattgcggcacgcgagcatctgtttcagtgggcgcaggaagagcaaatcgattttgatttaaagcagaaaggcattctgcatatttaccgcgataaagcgggctatgaccacgccgccaaggtctcacaactgctcagcaaaggcggcctggagcgtcgcgcggtaacccctgacgagatgcgcactatcgagccgacgctggcgggcaactactatggtggcttctttaccgaaagcgatgccacgggtgatattcataagtttacccacggcctggctcaagccgccgagcgccgtggtgtaacgcttaaatatggccacagcgtgcaggatctcggcgcggacgaacagcacgcatgggtcaccgccaccattgaaggcgaggccgacggtgaaccggtgcgtgaaacattcgatagcgtggtggtctgcgccggggtgggcagccgtgccctggctgccaagctgggagaccgggtcaatatctacccggtcaaaggctactccattaccgtgcagcttgacgatgccgcctcccagcaggccgcccccaccgtaagcctactcgatgatgaaaccaaactggtgaccagccgcctgggcgatgaccgctttcgtattgccggtaccgccgagttcaacggtttcaatcgcgacattcgcgacaaccgcatccgcccattgatccgctgggtggaagagtgcttccccggcgtcagcacccgccgcgtagtgccctgggcaggcctacgcccgatgcttcccaacatgctgcctaaggtcggccccggcaaattacccaccgtgttctacaacaccggccacggccacctgggctggacgctctctgcgattaccgccgatatgctggcggatgcggtgcaagcggcggaagaagcatcggcaccagcgagagcatcacactcagtgtga

SEQ ID NO: 460 - protein, 421 aa, Unknown
  Obtained from environmental sample
  SIGNAL (1)...(21)
  DOMAIN (3)...(404): FAD dependent oxidoreductase
  SITE (104)...(107): N-glycosylation site. Prosite id = PS00001
MQRIAVIGGGITGITSAYALAKRGYQVTVFEKHRYAAMETSFANGGQLSASNAEVWNHWPTVIKGMRWMLRNDAPLLVNPRPSWHKLSWFGEFIASIPRYSENTTETARLAIAAREHLFQWAQEEQIDFDLKQKGILHIYRDKAGYDHAAKVSQLLSKGGLERRAVTPDEMRTIEPTLAGNYYGGFFTESDATGDIHKFTHGLAQAAERRGVTLKYGHSVQDLGADEQHAWVTATIEGEADGEPVRETFDSVVVCAGVGSRALAAKLGDRVNIYPVKGYSITVQLDDAASQQAAPTVSLLDDETKLVTSRLGDDRFRIAGTAEFNGFNRDIRDNRIRPLIRWVEECFPGVSTRRVVPWAGLRPMLPNMLPKVGPGKLPTVFYNTGHGHLGWTLSAITADMLADAVQAAEEASAPARASHSV

SEQ ID NO: 461 - DNA, 762 bp, Unknown
  Obtained from environmental sample
atgcctagcgtacttatcacaggagctacttcagggtttggtaaagcggcagcacagcgcttcgccaaagcaggctggtcgttgatcctcaccggtcgccgccaggaacgcttagatgcactggaaaaagagctaagccagcaggttccagtacttacactggcactggatgtccgcgacagcgacgctgtgactgacactattagcaacctgccggaaagctttctgccgctgacgtgcctgattaacaatgcagggttagcgttagcgccggagccagcgcaaaaagtcgcgctgcaggattggcacaccatgatcgataccaacatcaccgggttggtcaacgtcacccacgcggcattgccgctactgctcaaaaacagcgaaggtgcgagcattcttaatttaggctcagtcgcaggccagtggccgtatccgggcgggcatgtgtatggggcgtcaaaagcgtttgttcagcagtttagttataacctgcgctgcgacctgctaggaacaggtgtccgcgtgaccgatcttgcccccggcatggcagaaaccgagtttacgctggtaagaaccaagggcaatcaggccgcgtcagacgcactttataaaggaacaacgccacttcaagcggaagatattgccgagcagcttttctacctagcgacactgcccgcccatatcaatattaatcggttggaaatcatgccggtgcggcaagcgtggtcagcatttgccattgaccgcgacccggcttaa

SEQ ID NO: 462 - protein, 253 aa, Unknown
  Obtained from environmental sample
  DOMAIN (2)...(170): short chain dehydrogenase
  DOMAIN (2)...(182): KR domain
  DOMAIN (4)...(232): NAD dependent epimerase/dehydratase family
  SITE (110)...(113): N-glycosylation site. Prosite id = PS00001
  SITE (116)...(119): N-glycosylation site. Prosite id = PS00001
  SITE (140)...(168): Short-chain dehydrogenases/reductases family signature. Prosite id = PS00061
MPSVLITGATSGFGKAAAQRFAKAGWSLILTGRRQERLDALEKELSQQVPVLTLALDVRDSDAVTDTISNLPESFLPLTCLINNAGLALAPEPAQKVALQDWHTMIDTNITGLVNVTHAALPLLLKNSEGASILNLGSVAGQWPYPGGHVYGASKAFVQQFSYNLRCDLLGTGVRVTDLAPGMAETEFTLVRTKGNQAASDALYKGTTPLQAEDIAEQLFYLATLPAHININRLEIMPVRQAWSAFAIDRDPA

SEQ ID NO: 463 - DNA, 1248 bp, Unknown
  Obtained from environmental sample
atgggtaaaaatattgttattgttggcggtggaattattggattgaacgcagcctattatttgcagaaagagggacataaagtaactgtaattgataaaagtgatatttcttcaggagcatcttttgtaaatgcaggatatattacgccaagtcatattatccctttggcggctccgggaatgatatctaaagggattaaatggatgtttaattcttctagccctttttacataaaacctcgattagatattgattttttaaaatggtcttgggcttttaaaaaatcgtccacagctgccaaggtagaaaaagccatcccagttattaaagatataaatctattgagtagaggtttatacgaagacatgaaagtatcaggtgattttgattttcaatatgaacgtaagggcttactcatgtgctataagactgaaaagggtggtgaagaagaatgggaagtaggaaaacgtgctatcaaagaggggttgaatgtccaaaatttaacagctcaagaagttcataaactggaacccaatgccaaattaaatattaaaggagctgtttattttgattcggatgcccatatgacacctggcgagttcatgaatgagatggtacgttatttaaaggtaaagaaggttacatttttaaccaacgaggaagtaatagatatggtattgtctaatgataaaatatcagaggtcataacagataaaagaaatttgaaggtcgatgaagtagtaattgcagccggtagctggagtccgttggttactaaaaaattgggattgaagattcttatacaggcagggaaaggataccggattaatgtcaaacgtcagacaggcattactattccggcaattttagtagaagctaaagttgcagtaacccctatgaacagctttacgcgttttgccggaactatggaaatagccggtataaaccataaaataaatcctgtacgtgtgaagactatagctagagctgcggaatcttattatgagggattaaaaatagaacagctggaagtagataatgctgcatgtgggttaaggccttgttctcctgacggattaccttatataggtagagccagtaagtataaaaatttaactatagcaaccggacacgctatgatgggttggagtatggcaacagccaccggtaaattgatttcagaaattatttcagatcagaaattatctgtgaatattgatatgtttgatcctgaaaggaaattttaa

SEQ ID NO: 464 - protein, 415 aa, Unknown
  Obtained from environmental sample
  DOMAIN (4)...(396): FAD dependent oxidoreductase
  SITE (72)...(75): N-glycosylation site. Prosite id = PS00001
  SITE (169)...(172): N-glycosylation site. Prosite id = PS00001
  SITE (376)...(379): N-glycosylation site. Prosite id = PS00001
MGKNIVIVGGGIIGLNAAYYLQKEGHKVTVIDKSDISSGASFVNAGYITPSHIIPLAAPGMISKGIKWMFNSSSPFYIKPRLDIDFLKWSWAFKKSSTAAKVEKAIPVIKDINLLSRGLYEDMKVSGDFDFQYERKGLLMCYKTEKGGEEEWEVGKRAIKEGLNVQNLTAQEVHKLEPNAKLNIKGAVYFDSDAHMTPGEFMNEMVRYLKVKKVTFLTNEEVIDMVLSNDKISEVITDKRNLKVDEVVIAAGSWSPLVTKKLGLKILIQAGKGYRINVKRQTGITIPAILVEAKVAVTPMNSFTRFAGTMEIAGINHKINPVRVKTIARAAESYYEGLKIEQLEVDNAACGLRPCSPDGLPYIGRASKYKNLTIATGHAMMGWSMATATGKLISEIISDQKLSVNIDMFDPERKF

SEQ ID NO: 465 - DNA, 444 bp, Unknown
  Obtained from environmental sample
atgaccgctcgccgctggaccgtcctgaccgaacctttgcaaccacccttcgatgtcacgcggggcgtggagctgccgatcctggagcgtgttggcgcggatctggtggtggcggattcggcggaggcatggcgggaggccgcgccggatgccgacgccgtgctgcactggcgcatgccgattggcccggatgagatcgcgcggctcgaacgctgccgagtgatcgtgcactatggcgtcggcgttgaccgcatcgatttcaccggagccgctgccgccgggatttatgtggccaatgtcccccgctatggcacctccgaggtggcggaccacgccatggcgctgctgctggcgtcggtgcgcaaggtgcgacgcctcgatctggcgctgcgccaggggggatggggcgtgcacgcggtgcggccggtgccgcgcatctcgggg

SEQ ID NO: 466 - protein, 148 aa, Unknown
  Obtained from environmental sample
  DOMAIN (19)...(131): D-isomer specific 2-hydroxyacid dehydrogenase, catalytic domain
MTARRWTVLTEPLQPPFDVTRGVELPILERVGADLVVADSAEAWREAAPDADAVLHWRMPIGPDEIARLERCRVIVHYGVGVDRIDFTGAAAAGIYVANVPRYGTSEVADHAMALLLASVRKVRRLDLALRQGGWGVHAVRPVPRISG

SEQ ID NO: 467 - DNA, 1242 bp, Unknown
  Obtained from environmental sample
atggcacacgacattgtggtgctgggggccggcatgatcggcacctgcaccgcactcgaactgacgctgcgcggccatgccgtgacgcttgtcgaccggcagccgcccggacgcgagacgtcctatggcaatgcgggcgtcatccagcgcgaagcggtcgagccctatgcctttccgcgcgatgtgcgcaccatccttgccgcagccttcggtcgcgggctggacatccactatcaggcggcgggcctgttcggcgccttgccgcaattgatgcgctactggtggcattcggcgccgtcgcgacaccgacgcatcggaaaggcatatgccggcctgattgcccatgtcaccgaagagcacgggcgctacatggcgcttgcgggtgcgcaggatcttgtgcgacgcgaaggcctgcgcctgatgtaccgcagcgggcacgcgatggaagccgcggccgcgcacgcgcagcagctgcaccgcgaccatgggatcggcctggctctgctcgatgcgcgcgcccttgctgcggccgagcctgcctttcgcatccccatggcaggtgcggtccactggctggattcgtggagcgtcagtgatcccggcgcgctggtcgaacggtacgagtgcgcgtttcggcagcgtggtggccgattcgccagaggagacgcgaacagcttgcgtgagcgcgctggcggctgggaggtgcgtcttgacgaaggcgtcgtgcaggcgcgctatgccgtcgtggcattgggcccctggtccgatgtgctgacgcggcgcatgggctatcggctgccgctgttcatcaagcggggctaccaccggcattacgcaggcggcgacggtgtcaacgttccgacgctggacgcggagcggggctatgtgatgtcttcgcagcaacgcggcctgcgcatcaccaccggtgcggagattgcacgcatggatgctccctccacgccacgccagctcgccggcgcggaggccgaggtgcgcaagctgctgaacctcgggctgccggtcgaggcgcagccgtggctcggaagccggccttgctgtgccgacatgaaaccggtcatcggtcgcgcgcagcgccacaagggcctgtggttcaacttcgggcacggccaccacggcttcacgttggggccggccagtgcgcggctcctggcagacctgatcgaaggtggcacgccttacgcggaggcgacggcgttttcgccctcgaggtttccatgctag

SEQ ID NO: 468 - protein, 413 aa, Unknown
  Obtained from environmental sample
  DOMAIN (4)...(393): FAD dependent oxidoreductase
MAHDIVVLGAGMIGTCTALELTLRGHAVTLVDRQPPGRETSYGNAGVIQREAVEPYAFPRDVRTILAAAFGRGLDIHYQAAGLFGALPQLMRYWWHSAPSRHRRIGKAYAGLIAHVTEEHGRYMALAGAQDLVRREGLRLMYRSGHAMEAAAAHAQQLHRDHGIGLALLDARALAAAEPAFRIPMAGAVHWLDSWSVSDPGALVERYECAFRQRGGRFARGDANSLRERAGGWEVRLDEGVVQARYAVVALGPWSDVLTRRMGYRLPLFIKRGYHRHYAGGDGVNVPTLDAERGYVMSSQQRGLRITTGAEIARMDAPSTPRQLAGAEAEVRKLLNLGLPVEAQPWLGSRPCCADMKPVIGRAQRHKGLWFNFGHGHHGFTLGPASARLLADLIEGGTPYAEATAFSPSRFPC

SEQ ID NO: 469 - DNA, 1245 bp, Unknown
  Obtained from environmental sample
atgacagcggatgcgattgtccttggtgcgggcataattggggtttccacagcactgcaactggcccgtcgcggcaagtccgtcgtccttgtcgaccgccgcggcccgggtgaggaaacatcctacggcaatgccggcctcatccagcgcgaaggtgtcgttccctacggctttccgcagcagttcggccagatcctgcgctacgcactgaacaaccagatcgatgcccattttcactggcgcgccatcccaaccgtcagctcctttctcgcgaaatactggtggcattcgaatctcagccggcaccagctgatcgcaagggcctatgcgccgcttatcgagcattcgatcgacacccatgacgagttgatcagagaggccggcgcggagcacctcattgccaaggacggctggacggaactcttccgtaccccctcgaaacgggaccgggaactgaaggaggcggcacgcctcgccaaggaatacggcgtcagcttcaaggaattggcgcccgcggaacttgcagcgcaggagccgcatctgagcacggaattcgtcggcggactgaaatgggaagacccctggtccgttctcgatcctcacgcgctgaccatggcctatgtccgcctgttcgagaaactgggcggacgcgtgctgaagggcgacgccaggagcctgtcgcagacggcgaccggctggcgcgtggtggccggcgacggcaccgtcgaagccaaggatgcggtcgtggcgctcggcccctggtcggacaccgtgacgcggccgctcggctatcgcttcctggtcggcgtcaagcgcggctaccacatgcattacggcgcgaagggcaatgcgaagctcaacggctggaccatggatgccgagcggggctattttctcgcgccgatgacgcaaggcatccggctgaccaccggggccgagttcgcgttgcgcgatgcgccgaagacacccgttcagctccagcgcgccgagaccgtggcgcggacgatcttcccgctcggcgagcggctggacgaggagccctggatgggcgcccgcccctgcacgcccgacatgatgccggtgatcggcgaagcgccgcggcacaaggggctgtggttcgccttcggacatgcccatcacggcctgaccctcgggccgattacgggccaggtcatcgccgaggcgattgccggggaaaagacgcgcatcgacatttccgcctaccgcccggatcgcttcgcctga

SEQ ID NO: 470 - protein, 414 aa, Unknown
  Obtained from environmental sample
  DOMAIN (4)...(395): FAD dependent oxidoreductase
  SITE (99)...(102): N-glycosylation site. Prosite id = PS00001
MTADAIVLGAGIIGVSTALQLARRGKSVVLVDRRGPGEETSYGNAGLIQREGVVPYGFPQQFGQILRYALNNQIDAHFHWRAIPTVSSFLAKYWWHSNLSRHQLIARAYAPLIEHSIDTHDELIREAGAEHLIAKDGWTELFRTPSKRDRELKEAARLAKEYGVSFKELAPAELAAQEPHLSTEFVGGLKWEDPWSVLDPHALTMAYVRLFEKLGGRVLKGDARSLSQTATGWRVVAGDGTVEAKDAVVALGPWSDTVTRPLGYRFLVGVKRGYHMHYGAKGNAKLNGWTMDAERGYFLAPMTQGIRLTTGAEFALRDAPKTPVQLQRAETVARTIFPLGERLDEEPWMGARPCTPDMMPVIGEAPRHKGLWFAFGHAHHGLTLGPITGQVIAEAIAGEKTRIDISAYRPDRFA

SEQ ID NO: 471 - DNA, 1299 bp, Unknown
  Obtained from environmental sample
atgcgagttgtcatactgggaagtggtgtggtaggcgttgccagcgcctggtacttaaatcaggcaggacatgaggtcaccgtcattgatcgggagccgggggccgccctggaaaccagtgccgcgaatgccgggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactacatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaatgcgacccgcgatatcgccgtgctggaagatgccggcgtaccgtatcagctgctggaatccagccgcctggcggaagtggagcccgcgctggcagaagtggcgcacaaactgacgggcggcctgcagttacccaatgatgaaaccggagactgtcagctatttacccagaatctggcgcggatggcggagcaggcgggggttaaattccgctttaatacgcccgttgaccaactgctttgcgacggcgagcaaatctacggcgtgaagtgtggcgatgaagtgattaaggccgatgcgtatgtgatggcgtttggttcttactcgacggcgatgctcaaaggcattgttgatattccggtgtatccgctgaaaggctactcgctgaccattccaattgcgcaggaagatggtgcgccggtatccaccattcttgatgaaacctacaaaatcgccattacccgtttcgataaccgcattcgtgttggcggaatggcggagattgttggttttaataccgagctgttgcaaccgcgtcgtgaaacgctggagatggtggttcgcgatctctatccacgcggcggtcatgtcgagcaggcgactttctggactggtctgcgcccgatgacgccagacggcacgccggttgtcgggcgtacacgctttaaaaatctgtggctgaataccggtcacggcacgctcggctggacgatggcttgcggttccggtcagttgttaagcgatctgctctctggtcgcacgccagcgatcccatatgaggatctaagcgtagcgcgctacagccgtggatttacgccatcacgtccgggccatttacatggcgcacacagctaa

SEQ ID NO: 472 - protein, 432 aa, Unknown
  Obtained from environmental sample
  DOMAIN (2)...(397): FAD dependent oxidoreductase
  SITE (151)...(154): N-glycosylation site. Prosite id = PS00001
MRVVILGSGVVGVASAWYLNQAGHEVTVIDREPGAALETSAANAGQISPGYAAPWAAPGVPLKAIKWMFQRHAPLAVRLDGTQFQLKWMWQMLRNCDTSHYMENKGRMVRLAEYSRDCLKALRAETNIQYEGRQGGTLQLFRTEQQYENATRDIAVLEDAGVPYQLLESSRLAEVEPALAEVAHKLTGGLQLPNDETGDCQLFTQNLARMAEQAGVKFRFNTPVDQLLCDGEQIYGVKCGDEVIKADAYVMAFGSYSTAMLKGIVDIPVYPLKGYSLTIPIAQEDGAPVSTILDETYKIAITRFDNRIRVGGMAEIVGFNTELLQPRRETLEMVVRDLYPRGGHVEQATFWTGLRPMTPDGTPVVGRTRFKNLWLNTGHGTLGWTMACGSGQLLSDLLSGRTPAIPYEDLSVARYSRGFTPSRPGHLHGAHS

SEQ ID NO: 473 - DNA, 1248 bp, Unknown
  Obtained from environmental sample
atgcgtaaggatgttgttgttctcggcgctggcatcgtcggcgtatcggccgccattcacctgcagaagcgcggacgctccgttctcctggtcgacaagcgcacgccgggcctcgaaacctccttcggcaatgcgggcctgatccagcgcgagggcgtctatccgtacggcttcccgcacgatttcggcgcgctcctgcgctatgcgctcaacaacaccatcgacgcccattaccatctggcggcgctgccgaagatcgcgcccttcctgttccagtactggatgcattcgcgcccggcgcagcacaaggctatcgcgcgcctctacgcgccgctgatcgagaacagcgtcaccgagcacatggcgctcgccgacgaggcgggctccgcggatctcatccgcccgaccggctggatgaaggtgttccgctccgaaaaggccatggaggagcagcttcgcgatgccgaacaggtcaagcgcgacttcggcgtcaacttcgtcgggctgaacacgaaggacgtggccgagcgggagccgcacctgaaggcggagctgaagggcggcatccactggaccgatccggcagcgatcttcgatccctacaaccttgtcctctcttacgtggagctgttcgagaagctcggcggcgaggtcgcggcgggcgacgccaagaccctcgagcagacctccgacggctggcgcctccagaccgagaagggaccgttcgaagcccgcgacgtagtggtagccctcggcccctgggccgacgtggtgatgaagaagctcggctaccacttcccgctcgcagtgaagcgcggctaccacatgcactacaagcccgagggcaacgcggtgctcaaccgcccgacgctcgatttcgagcgcggctactttctcgccccgatggcgaagggcatccgcctcaccacgggcgcggaattcgccgaccgcgacgcgccgaagaccccggtgcagctccagcgcgccgagccgatcgcacgggccttcttcccgctgggcgagcgggtcgatccggagccgtggatggggatgcgtccctgcacgccggacatgatgccgatcatcggccaggcgccccggcacaaaaatctgtggctcaccttcggccatgcccatcacggcatgacgctgggccccgtcaccggccgcctcatctccgagatgatcacgggccagcccaccatcgtcgatccgaagccctaccggccggagcggttctcggtctga

SEQ ID NO: 474 - protein, 415 aa, Unknown
  Obtained from environmental sample
  DOMAIN (4)...(395): FAD dependent oxidoreductase
  SITE (72)...(75): N-glycosylation site. Prosite id = PS00001
MRKDVVVLGAGIVGVSAAIHLQKRGRSVLLVDKRTPGLETSFGNAGLIQREGVYPYGFPHDFGALLRYALNNTIDAHYHLAALPKIAPFLFQYWMHSRPAQHKAIARLYAPLIENSVTEHMALADEAGSADLIRPTGWMKVFRSEKAMEEQLRDAEQVKRDFGVNFVGLNTKDVAEREPHLKAELKGGIHWTDPAAIFDPYNLVLSYVELFEKLGGEVAAGDAKTLEQTSDGWRLQTEKGPFEARDVVVALGPWADVVMKKLGYHFPLAVKRGYHMHYKPEGNAVLNRPTLDFERGYFLAPMAKGIRLTTGAEFADRDAPKTPVQLQRAEPIARAFFPLGERVDPEPWMGMRPCTPDMMPIIGQAPRHKNLWLTFGHAHHGMTLGPVTGRLISEMITGQPTIVDPKPYRPERFSV

SEQ ID NO: 475 - DNA, 1341 bp, Unknown
  Obtained from environmental sample
atgtcccttgcttttatctgcatcgcgacgaagttcaaaggcaagcctgtatgccggattctggagggcgatgtgagacgccgcgagatcatcattatcggagccgggctggccggggtttccgccgcctggacgctgcgccggcacggccattcggtgacggtgctcgacgccctgtccgggccggcgctggagaccagcttcgccaatgccggcgcgctgacgccgtcggagccggaaccgtggaatgcgccgggtgttgccgggcaattgcttgcctcgctgtttgatcccggcgccgcgatgaaattgcgcctcgcgcccctgcccggcctgatcggctggggcctgcgcttcctgcgcaattccacccatgcgcgccatggcgctgccagcgcagcgaatttcgccctctcgcgctacagccttgccgagacccaggccgtgcgcgatgagctcgggctggaattcgacaatctccgccgcgggacgctgaagctctgccgcagccaggacggtatcgaggcctccatcctggcggcggagaagctggtcccgctcggcctgcgctatgaagtgctcgaccgcgccgcgaccctggagctggaaccacagctggcgggcatcaccgaccagatcgccggctcgatccattatcccgacgacgaatccggcgatgcccatcgcttcacggccgggctggcggcggcggccgaaaaggccggggtcaaattcgaatgggaaacgcgcgtcaccgagttgatggatcgcggcggccatattgtcggcgtccgcaccgagaccgaagagatcgaggccgataccatcatcctcgctgccggccacacggcctggagcctgatgaaaccgctcggcctgcacctgccggtgcgtccagtgaagggctattccctcacattggacatgtccggcctcaatgcccggcccggcacaccggtattcgacgaggcgctgcatgccatcgtcacgccgatgggcaatcgtctgcgcatcgccggcaccgccgagatcgccggcaatgaccggcaattgcgcccggaacgggtggaaaacctcaaatccctggtccgcgccctctatcccgaatttgccgacacgctgctggccggcgagatcaatgcctggaccggcttccggccgatgagcgccgatggccgccccttcatcggcgagacccgcgccaagggcctgtggctgaccaccggccatggtcatctcggctggacccaggcgatgggctcggccgggctgctggccgcattgatggacagcgagacgccgccggtcgatcccgcaccgttcgcggcgagccggatctga

SEQ ID NO: 476 - protein, 446 aa, Unknown
  Obtained from environmental sample
  DOMAIN (29)...(428): FAD dependent oxidoreductase
  SITE (123)...(126): N-glycosylation site. Prosite id = PS00001
MSLAFICIATKFKGKPVCRILEGDVRRREIIIIGAGLAGVSAAWTLRRHGHSVTVLDALSGPALETSFANAGALTPSEPEPWNAPGVAGQLLASLFDPGAAMKLRLAPLPGLIGWGLRFLRNSTHARHGAASAANFALSRYSLAETQAVRDELGLEFDNLRRGTLKLCRSQDGIEASILAAEKLVPLGLRYEVLDRAATLELEPQLAGITDQIAGSIHYPDDESGDAHRFTAGLAAAAEKAGVKFEWETRVTELMDRGGHIVGVRTETEEIEADTIILAAGHTAWSLMKPLGLHLPVRPVKGYSLTLDMSGLNARPGTPVFDEALHAIVTPMGNRLRIAGTAEIAGNDRQLRPERVENLKSLVRALYPEFADTLLAGEINAWTGFRPMSADGRPFIGETRAKGLWLTTGHGHLGWTQAMGSAGLLAALMDSETPPVDPAPFAASRI

SEQ ID NO: 477 - DNA, 1239 bp, Unknown
  Obtained from environmental sample
atgaaggaatcgtacgatgttgttgtagtgggtgggggcgttattggtctttgcagcgcatactatcttcagaaaactggagccagcgtgttggttgtggatagggggcggtataccgaagctgcctccacgggtaacgcggggatgattgtgcccagccacattgtacctctttccgccccgggggttattgcaaagggccttaagtggctgatgaatcctgagagcccgctgtatatcaaacctagcgccaaccctaagttcatgaagtggttgtggctgtttcagaaacattgcacggcggaccatgtggcgtatagcatcccgatattgcgcgatctgagtttgttaagtagggacctctttggcgatttgtgtgctcttcccgggtttgaagatgtaggattggcacacgaaggcctcctaatgctacatcgtagttcatgggcggaaaaagacaatcttgaattagccaatttggcggaaaaagcgggccttgaaattcgccggttgaatgccgcacagacgttggaactggagcccgctttaaagaccgaagtgacaggtgctgtgtattttaagcaggattccagtttacatcctgaacggtttttgcgcgcgatggaaggctatttacgagaagctggagttgacttcttggatggcgaagtcatttcgtttgaacgggctggcgaaaacgtatcggcagtaagaactaagaaacaaatatttaggacacagcatgttgtcctttccagtgggagttgggcgccgcacttggcctcaaaacttggctcttcgattgcggttcaacccgcgaagggatacagcatcaccgttccggtaactgagcctagccttaaaataccgtgcgtcattgccgatgaaaaagtgaccataacacccttgccaggatgtattcgatttggcggtacattggcgcttcaagggtttgataattcgattgatgaacgacgtgcaagtccgattcgtcgtcaagcggaggcatattgcgatgccgcagccgatgcgcctacttgggcgggattcagacctgcttccccggatggtttaccgtttattggatgtttacccaaagcacctaatgtagtagtcgccacggggcatggaatgatgggtgttacactaggccccgtaaccggcctgttggtttctgaattgatctctggcaaaaaacaaagtattgacactgcgccatttagtgcagatagacactaa

SEQ ID NO: 478 - protein, 412 aa, Unknown
  Obtained from environmental sample
  DOMAIN (6)...(394): FAD dependent oxidoreductase
  SITE (236)...(239): N-glycosylation site. Prosite id = PS00001
MKESYDVVVVGGGVIGLCSAYYLQKTGASVLVVDRGRYTEAASTGNAGMIVPSHIVPLSAPGVIAKGLKWLMNPESPLYIKPSANPKFMKWLWLFQKHCTADHVAYSIPILRDLSLLSRDLFGDLCALPGFEDVGLAHEGLLMLHRSSWAEKDNLELANLAEKAGLEIRRLNAAQTLELEPALKTEVTGAVYFKQDSSLHPERFLRAMEGYLREAGVDFLDGEVISFERAGENVSAVRTKKQIFRTQHVVLSSGSWAPHLASKLGSSIAVQPAKGYSITVPVTEPSLKIPCVIADEKVTITPLPGCIRFGGTLALQGFDNSIDERRASPIRRQAEAYCDAAADAPTWAGFRPASPDGLPFIGCLPKAPNVVVATGHGMMGVTLGPVTGLLVSELISGKKQSIDTAPFSADRH

SEQ ID NO: 479 - DNA, 1239 bp, Unknown; identical to SEQ ID NO: 477
  Obtained from environmental sample

SEQ ID NO: 480 - protein, 412 aa, Unknown; identical to SEQ ID NO: 478
  Obtained from environmental sample
  DOMAIN (6)...(394): FAD dependent oxidoreductase
  SITE (236)...(239): N-glycosylation site. Prosite id = PS00001

SEQ ID NO: 481 - DNA, 1251 bp, Unknown
  Obtained from environmental sample
atgggaaaaaacgttttgatcatcggcggaggaattgtgggactctgttctgcatattttttacacaaagaagggcatcaagtaaccgttttggataagtcggatattacttcaggagcctcttttgtcaacgctggatatattactccaagccatattattcctctggcttctccgggaatgattttaaaaggaatcaagtggatgtttagtccaaccagtcctttttatatgcaacccagatgggatatcgacttttttaaatggtcctggtattttcagaaatcttcaacaaaggaaaaggtagcactggccattccgttaattaaagaaattaacctaataagtagggaactttttacagccattaaaaattccggggatttaggagattttcagctggaacgaaagggcttgttaatgttatataaaactgaggctgaaggggaacatgaaatgcgcgtggcggaaaaagcttcctttttaggcctagaagttagtaacttggataagaatactttggataaattgcagccccaggtgaccatggatgttagaggggcaattcattatgagtgtgacggacataccacaccaacagaattcatggagaaaatgctggattatttaaagcgaaacggtgtaatcatcaaaaccaatgaggaggtcacggatatagtgacagataatagccgaataaccaaagtaatttcagaaaagaccgagtattcagccgatgaaattgttttggcggcaggatcttggagcgagaaattatccaaaaaaatgaggctaaaactccccatacaggcaggtaaaggatacagtataaacgtaccgcgcccaaccgggattaccattcctgccattttaatggaagctaaggtagccgtgactcctatgaaggagtatacccgctttgcaggaaccatggaattttctggaataaacgaaataattaataaacagcgcgttgaggctatagccagagcggtcaaggagttttatccaaaaatagaaatcaatgccaaggaaatagctaatgccaaaagtggtcttcgcccagtttctccggatggattgccctatattggaaaaagtagttcccttaaaaatttaactattgccacaggacatgccatgatgggctggagtcttggaccggttaccggacaattggtctcggaaataatatcgaacaaaaaaacatctatggatattgccggcttttccccaaataggaggttctag

SEQ ID NO: 482 - protein, 416 aa, Unknown
  Obtained from environmental sample
  DOMAIN (4)...(397): FAD dependent oxidoreductase
  SITE (377)...(380): N-glycosylation site. Prosite id = PS00001
MGKNVLIIGGGIVGLCSAYFLHKEGHQVTVLDKSDITSGASFVNAGYITPSHIIPLASPGMILKGIKWMFSPTSPFYMQPRWDIDFFKWSWYFQKSSTKEKVALAIPLIKEINLISRELFTAIKNSGDLGDFQLERKGLLMLYKTEAEGEHEMRVAEKASFLGLEVSNLDKNTLDKLQPQVTMDVRGAIHYECDGHTTPTEFMEKMLDYLKRNGVIIKTNEEVTDIVTDNSRITKVISEKTEYSADEIVLAAGSWSEKLSKKMRLKLPIQAGKGYSINVPRPTGITIPAILMEAKVAVTPMKEYTRFAGTMEFSGINEIINKQRVEAIARAVKEFYPKIEINAKEIANAKSGLRPVSPDGLPYIGKSSSLKNLTIATGHAMMGWSLGPVTGQLVSEIISNKKTSMDIAGFSPNRRF

SEQ ID NO: 483 - DNA, 1311 bp, Unknown
  Obtained from environmental sample
atgaaagtaatcgttctgggttcgggcatcatcggcactgctaccgcgtggtttttgcataagtcaggacacgacgtcagcgtgatcgaacgccaacccggcgcagcacaggaaaccagtttcgccaacggttgccagatctccgtatcgcacgccgagccatgggccaatcccgccgcgccgatgaaagtgttgaaatggctgggcaaggaagatgcgccactgctgtatcgcttccgcccggaatggctgcaatggaaatggggcatgcacttcctgcgcgaatgcacgcctgcgcggaccgcttataacatccgccagatcgtcaccatcgccgagtacagccgtcaaaccctgcaaaccctgcgtgctgaaaccggcatcgattacgattgcctgacacgcggcatcctgcacttctataccgatcaaaaggaattcgacgattccctgcccgccgccaacctgatgcgcgaactgggctgcccgcgcgaatcgataggcgcggacgaagtcgtccgcatcgaaccggcgctggctcgtatccgccacaagatcgtcggcggtgactttactgcgaccgacgaatccggcgatatctataaattcaccaccgggctggcaaagaaggcagagcaggcgggcgtcgattttcagttcaacaccacgattacccgcctgttgaaggaaggcactggtgccgctgcaaagatcacgggcgtcgaagtgatcgatgcggaaggcaggcataaggtcttgcgcgccgatgctttcgtcgtcgcgatgggcagcttctccaccacattgctgcaaccgttgggcatcgacctgatggtttatccaggcaaaggctactccgcgacttaccaggtgaccgatagcgccgccgcacccagcgtctcactgactgacgacggccacaagctggtggtgtcgcgcctgggcgaccgcttgcgcgtagcaggaacctgcgaactgaatggctactcacgcgagttgaatacgacgcgctgtgaagcgatcacccgtcgcacgcaagagctttttccggatgcctgcgactacgacaatccggtgtactgggccggcctgcgtccattgacaccatcgaacgtaccgtatatcggcaagacccggtacagcaacctcttcctcaataccgggcatggcacgctgggctggacgatgggcgcaggttcgggccgcgcattggccgacatcatctccggtcgtcaaccggatctcgactttgccttcaccggcatgccgaaacgtgctgcggtgcacgacttagccgtacagccagtctga

SEQ ID NO: 484 - protein, 436 aa, Unknown
  Obtained from environmental sample
  DOMAIN (2)...(407): FAD dependent oxidoreductase
  SITE (224)...(227): N-glycosylation site. Prosite id = PS00001
  SITE (339)...(342): N-glycosylation site. Prosite id = PS00001
MKVIVLGSGIIGTATAWFLHKSGHDVSVIERQPGAAQETSFANGCQISVSHAEPWANPAAPMKVLKWLGKEDAPLLYRFRPEWLQWKWGMHFLRECTPARTAYNIRQIVTIAEYSRQTLQTLRAETGIDYDCLTRGILHFYTDQKEFDDSLPAANLMRELGCPRESIGADEVVRIEPALARIRHKIVGGDFTATDESGDIYKFTTGLAKKAEQAGVDFQFNTTITRLLKEGTGAAAKITGVEVIDAEGRHKVLRADAFVVAMGSFSTTLLQPLGIDLMVYPGKGYSATYQVTDSAAAPSVSLTDDGHKLVVSRLGDRLRVAGTCELNGYSRELNTTRCEAITRRTQELFPDACDYDNPVYWAGLRPLTPSNVPYIGKTRYSNLFLNTGHGTLGWTMGAGSGRALADIISGRQPDLDFAFTGMPKRAAVHDLAVQPV

SEQ ID NO: 485 - DNA, 1269 bp, Unknown
  Obtained from environmental sample
atgaaagtcatcgtattgggcagtggtgtgatcggcacgtcggtggcgtactatctggccaagtccggacaccaagtggaggtcatcgaccgccaagtcggccctgctctggaaaccagctttgccaatgccggtgaggtgtcaccgggctactcatcgccatgggctgggccgggcgtgccggtgaaggccatcaagtggatgctgatgcgccacagcccgctggtgatctggcctttgctggaccccaacatgtggcgctggggcttgtccatgctggccaactgcaccgaaaaagcctatgccaccaacaagagccgcatggtgccgattgccgaatacagccgcgactgcctcaaagagctgcgcgccgagactggcattgcgtatgacgaccgcgcacagggcacgctgcagctgtttcgcacacaggcgcagatggacggcatcgccaaggatgtggaagtgctgcaggactacaaagtgccgttcgaggtgctggaccgcgcaggcttcatcaaggtggaacccgcgctcaagctgacacaggaaaaattcgtgggcgcgttgcgtctacccggcgacgagactggcgactgcttcaagttcaccaaccgcctggctgaaatggccgaggcgcttggcgtcaaatttcgctacaacaccagcatcgacggcattgaggtcagcggcggcaaggtcagcggcgtgcgcaccagcgccggcaccttgacggccgaccactacgtcaccgcactgggcagcttcacaccgcaagtggtcaagcccatcggtatccatatcccggtctacccggtcaagggttactccatcaccgtgccgatcaccgatgccagcggcgcacccgagtccaccatcatggacgaaacgcacaaggtggccgtcacgcgcctgggcgaccgcatccgcgtaggcggaacggccgaactggcgggctttgacatgacgctgcgcgagtcgcgccgcgacacgctgaaccatgtgctgaccgacttattccccaagggcggcgacctgtccaaggccacgttctggtgcggcctgcgccccatgacgccagatggcacgcccatcgtcggacgcacgccctacgccaacatgatgctggccacgggccacggcacactgggctggacaatggcagcgggcacggcacgcgtcatcgacgatttgatctcggggcgcaagccacagatttcactggatggcctgtcgatggatcgttatccacgggcttggcgcggctag

SEQ ID NO: 486 - protein, 422 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
  SITE (224)...(227): N-glycosylation site. Prosite id = PS00001
MKVIVLGSGVIGTSVAYYLAKSGHQVEVIDRQVGPALETSFANAGEVSPGYSSPWAGPGVPVKAIKWMLMRHSPLVIWPLLDPNMWRWGLSMLANCTEKAYATNKSRMVPIAEYSRDCLKELRAETGIAYDDRAQGTLQLFRTQAQMDGIAKDVEVLQDYKVPFEVLDRAGFIKVEPALKLTQEKFVGALRLPGDETGDCFKFTNRLAEMAEALGVKFRYNTSIDGIEVSGGKVSGVRTSAGTLTADHYVTALGSFTPQVVKPIGIHIPVYPVKGYSITVPITDASGAPESTIMDETHKVAVTRLGDRIRVGGTAELAGFDMTLRESRRDTLNHVLTDLFPKGGDLSKATFWCGLRPMTPDGTPIVGRTPYANMMLATGHGTLGWTMAAGTARVIDDLISGRKPQISLDGLSMDRYPRAWRG

SEQ ID NO: 487 - DNA, 1263 bp, Unknown
  Obtained from environmental sample
atgacccaagatgttctcgttctcggtgctggtatcgttggcgtatcgacagccattcatcttttgcggcgaggccgttcggtggttcttgtcgacagggccgatccgggcaaggagacctcgtttggcaatgccgggattatccaacgcgaaggcgtgaggccacatgcgtttcctcgcgatcttgcgaccttggttcaggtcggtatgcacttgagcactgccgcgcgctacgatccgctggccctgcccagattcgcgccagcgctggcgcgttattggtgggaatccgcgcccaatcattacaagcgcatcgtcaaaagctatgccccgctgattgcccgctccatcgatgagcatgccgacttcattgccgccgcaggggttgaagacctgatcgtgaaaaagggctggctccttgcctatcgcaccgacaaggctttgggcgaagcgctggaaaacgcgcgcatggatttcgagctttacggcatcaaccaccgcgtcgtggagccgagccaattggcaagcctggaaccgcacctgaaagtcaagatggccggtgccgtacactggacagacccctggaccgtcaagaatcccggcgcactggtcgcggcttatgccgagcttttcaagtccatgggcggcaagatcgtcacaggcgaggcccagcgcctagactcagggaaagatgaatggtcacttgtcctcaaggatcagaccgtcacagcaagagaagctgtcgtgacacttggtccatgggcaccggaatttctggagccgctaggctaccggctgccgcttttcgtcaagcgtggctatcacatgcactacagcacacaaggcaatgcagtgctcaacaactggctgctcgacgccgaagtggggtatctgctcgcgcccatgcaaaatggcattcgtctcacgacaggagccgaatttgcgctgcgcgattcagcgcccacacccgtccagcttggcaaggccgagcgcaaggcacgcgatcttttcccgctggacaagcagctcgatcccaacccgtggaagggcgcccgcccctgcacgccggacatgatgccgatcatcggaccggcaacgaagcacaaggggctgtgggtggcgatcggacatgcccatcatggctttacccttgggccagcaaccggccgggtgctggcggaagccatgaccggcgagcagccggtcatagacatcaagcccttctcgatggaacggtttaccggcaattcgatcaggaattaa

SEQ ID NO: 488 - protein, 420 aa, Unknown
  Obtained from environmental sample
  DOMAIN (4)...(395): FAD dependent oxidoreductase
MTQDVLVLGAGIVGVSTAIHLLRRGRSVVLVDRADPGKETSFGNAGIIQREGVRPHAFPRDLATLVQVGMHLSTAARYDPLALPRFAPALARYWWESAPNHYKRIVKSYAPLIARSIDEHADFIAAAGVEDLIVKKGWLLAYRTDKALGEALENARMDFELYGINHRVVEPSQLASLEPHLKVKMAGAVHWTDPWTVKNPGALVAAYAELFKSMGGKIVTGEAQRLDSGKDEWSLVLKDQTVTAREAVVTLGPWAPEFLEPLGYRLPLFVKRGYHMHYSTQGNAVLNNWLLDAEVGYLLAPMQNGIRLTTGAEFALRDSAPTPVQLGKAERKARDLFPLDKQLDPNPWKGARPCTPDMMPIIGPATKHKGLWVAIGHAHHGFTLGPATGRVLAEAMTGEQPVIDIKPFSMERFTGNSIRN

SEQ ID NO: 489 - DNA, 1242 bp, Unknown
  Obtained from environmental sample
atgagcaaagacgtcatcgtcctcggcgccggcatggtcggcgtatcaacggcgctgcacctgcagcagcgcggccgctcggtggcgctggtggaccggcgtggcgtcgccgaggagacctcctacggcaacgcaggcatcatccagcgcgaaggcatcgtgccttacctctttccgcgcgaatgggccacgatcctgcgttacgcgcgaaaccagtctacagacgcagccttccagtggtcgtcgctgccgcgcgtggcgccgtggctgttccgctattggcgctggtcgaccgaagcgggcatgcacgcgaccgcgcgcgcgatggcgccgatcgtcacgcgttgcgtcgacgagcacgaagcgctgatgaatgccgccggagtcatcggcatgatccggcgcaccggctacctgcgcgtctatcgtacggagcagaccctcgaaaaggcaatccgcgaggatgccgagatcaagtccaagtacggagtcgtgaccaagccggtgacgccggcgcagctcgcggagctcgagccgcacttgaagccagtgttcgccggcggcgtgctgctgcccgatccatgcagcgtcgccgatccgaacgctctcggcaaagcctacgccgagctgttcgtgaaacgtggcggcgcgctcgtcgaaggcgaggcgcggtcgctggcgcaggatggtgccggctggaaggtcgcgacgcgcgatggctggatctcggcgccgaacgtcgtcgtagcgctggggccgtggtcggatacggttacccgcgcgcaggggcttcgcctgccgcttggagtcaagcgcggctaccacatgcattaccgaccggaaggcaacgcaacgttgagccggccggtcatcgatgggtcagtcggctttgccatggcgccgatgaccaagggtattcgcgtgacgacgggtgcggagttcgcaaccatcgatgcaccagcaaatacggtgcagctcgagcgcgtcgagccgctggcgcgcgccgcctttccgctcgccgagcgtgcggagcccacgccgtggctcgggcggcgtccgacgttccccgacatgctgccggtgatcggcgaagcagcgaaccggaagggcctttggatgaacttcggccaccaccatctcggcttcacgctcggcccggtgacaggccgcctcctcgccgaggtgatgacgggcgagaagccgttcaccgatccccatccctatcgcgccgagcgattctag

SEQ ID NO: 490 - protein, 413 aa, Unknown
  Obtained from environmental sample
  DOMAIN (4)...(395): FAD dependent oxidoreductase
  SITE (72)...(75): N-glycosylation site. Prosite id = PS00001
  SITE (287)...(290): N-glycosylation site. Prosite id = PS00001
MSKDVIVLGAGMVGVSTALHLQQRGRSVALVDRRGVAEETSYGNAGIIQREGIVPYLFPREWATILRYARNQSTDAAFQWSSLPRVAPWLFRYWRWSTEAGMHATARAMAPIVTRCVDEHEALMNAAGVIGMIRRTGYLRVYRTEQTLEKAIREDAEIKSKYGVVTKPVTPAQLAELEPHLKPVFAGGVLLPDPCSVADPNALGKAYAELFVKRGGALVEGEARSLAQDGAGWKVATRDGWISAPNVVVALGPWSDTVTRAQGLRLPLGVKRGYHMHYRPEGNATLSRPVIDGSVGFAMAPMTKGIRVTTGAEFATIDAPANTVQLERVEPLARAAFPLAERAEPTPWLGRRPTFPDMLPVIGEAANRKGLWMNFGHHHLGFTLGPVTGRLLAEVMTGEKPFTDPHPYRAERF

SEQ ID NO: 491 - DNA, 1290 bp, Unknown
  Obtained from environmental sample
atgaagatctcgatcgtcggtgccggccttgccggtctttgcgcggcgcacgcgctggtcgccgccggcgcgacgcgcgtcgacgtcttcgaccgcgccgccggcccgggcctggaaaccagcttcgccaacggcgcgctgctgcatccgagcgcggtcgatccctggaactcgcccggcatcaccggcacgctgatcggcagcctgttcgatgccgatgccgcgttccggctgcacccgcgggtgctgccgtccttgtggggctgggggtggcgctttctgcgcgagtcacgccgcgaccggtacgaaacccatggcctggccaatctggcgctggcacggctcagcgtgcagcgcatggccgcgctgcgcgacgaaggcatcgcctatggctgcgatcggcgcggctcgctcgcaccgtaccgggatgcggcgggttttgccgccgcttgcacgcgcgccgagcgcctggccgggttcggtctggaacatcgggtgctcgatcgtgaagcgatgctggcgctggagccggcactggccgcgatcgctgcgcagaccgtcggtgcgctgcacttcccgcacgacgaacaaggggatgcccatgccttctgcaatgcgctggcggcgcggctggcgcagcagggcgtgttgttccactggggcaccgaggtgcgcgcgctgcgcaccgtgggcagcgcggtgcggggcctcgagttggccgatggccgccgcgacgacgccgaccgggtggtgctggccgcggcagcgtggagcgcggcgctgacacgtccgctcggcctgcagctgccgctgcgcccggccaagggctactcgatcagcttcacgctcggcagcctggcggacggatcctcacctcccaacgtcccacgcatgccgatcgtcgaccatgatctgcacatcgccgcggtgccggtggccggtggccgcctgcgcgtggccggcaccgccgagctggtgggcttcgaccgccgcatcgatccgcgccgcaccgcattgctgttgcgccggttgcaccggctttacccggcgctggtgcccttgctcgacgcagcgccgcgccaggactggaccggcctgcgcccgctctcggccgacggcgtaccgctgatcggccccacccggatcggcggcctgtggctgaacaccgggcatggaccgatcggctggaccaccggcgtggcctcgggcgaactgctggccgacgcgatcttcggccgccgctctgcgatcgatccgacacccttcctgccgcagcgcttcgggctctga

SEQ ID NO: 492 - protein, 429 aa, Unknown
  Obtained from environmental sample
  SIGNAL (1)...(21)
  DOMAIN (2)...(409): FAD dependent oxidoreductase
  SITE (383)...(394): Lipocalin signature. Prosite id = PS00213
MKISIVGAGLAGLCAAHALVAAGATRVDVFDRAAGPGLETSFANGALLHPSAVDPWNSPGITGTLIGSLFDADAAFRLHPRVLPSLWGWGWRFLRESRRDRYETHGLANLALARLSVQRMAALRDEGIAYGCDRRGSLAPYRDAAGFAAACTRAERLAGFGLEHRVLDREAMLALEPALAAIAAQTVGALHFPHDEQGDAHAFCNALAARLAQQGVLFHWGTEVRALRTVGSAVRGLELADGRRDDADRVVLAAAAWSAALTRPLGLQLPLRPAKGYSISFTLGSLADGSSPPNVPRMPIVDHDLHIAAVPVAGGRLRVAGTAELVGFDRRIDPRRTALLLRRLHRLYPALVPLLDAAPRQDWTGLRPLSADGVPLIGPTRIGGLWLNTGHGPIGWTTGVASGELLADAIFGRRSAIDPTPFLPQRFGL

SEQ ID NO: 493 - DNA, 1344 bp, Unknown
  Obtained from environmental sample
atgcaagcactcgtcatcggcggcggcatcatcggcctgagcaccgcgtactacctgcgggaatccggctgggaggtgaccgttttggaaaaaggcgacctcaccgacaactgctcgttcggaaacatgggctacctgtcgccctcgcacttcgtgcccttggccgcgccgggcatgatcgagcagggcctcctgtggatgttcgatcccaaaagcccgttctacgtgcgcccgaggctgagctgggaactggcggactggggcctgaaattcatgcgggcctccacccgctcccacgtcgagcgcagcgcccgcccgctcgcggatttgctgctgctctcgaaacaattgatgcgcgattgggcggccacggacggcttcgattttgaactgaccgagcgcggctgcatgatgtatttccaaacggaaaaaaccgagcgcgaggaactcgaaaatgcccgcaaggccgaagacctcggcctgcacgtagaagtgctgggccgggaacaggtgcagatcatcgaaccggacgtgcggcccgacgtgcgcggcggggtgttgttcaaggacgacgcgcacctgtaccccaacgcgctcatgcagcagctgccggccgtgctggaaaaacgcggcgtgcggatcatccgaaacgccgaggtcgtgggtttcgaccgcgccaaaggcaaaatcaccgccgtccactaccgcacccccaactcaaccccgccttcggctgggcaagcactcaaaacttctttgtcacccccgcagggggcaaaactcaaaactgatctcctgattttggccgccggctcctggtcgccccaactggcgcgcatggccggcgagtacctgccgctcatgcccggcaaaggctactccatgaccgtggacaaccccgccaaaaaactccgctacccttgcatcctgctggaggccaaggtagcgctcacgccgtgggccaatcgcctgcgcatcggcagcacgatggagatcgggccgatcaacgaccgcatcctgttcccccgcgtgcagggcatcctcgaggccgtgccgcgctacctgccgggctttttggacgatcccgagtaccgggcgctcgccgatctggatgcgctgcgccaaaacctgcgcgaaaaggtctggtttggcttccggcccgtatccgccgacggcatgccctacatcggctacgcccggaaaaacgccaacctgatcatcgccacgggccacgccatgctgggcgtgagtttggccgccgggacgggaaaattggtggctgaattggccgatggtcaaggcaccacagtgcccgcacaggcgtttgatccgtgccgatactga

SEQ ID NO: 494 - protein, 447 aa, Unknown
  Obtained from environmental sample
  DOMAIN (2)...(429): FAD dependent oxidoreductase
  SITE (37)...(40): N-glycosylation site. Prosite id = PS00001
MQALVIGGGIIGLSTAYYLRESGWEVTVLEKGDLTDNCSFGNMGYLSPSHFVPLAAPGMIEQGLLWMFDPKSPFYVRPRLSWELADWGLKFMRASTRSHVERSARPLADLLLLSKQLMRDWAATDGFDFELTERGCMMYFQTEKTEREELENARKAEDLGLHVEVLGREQVQIIEPDVRPDVRGGVLFKDDAHLYPNALMQQLPAVLEKRGVRIIRNAEVVGFDRAKGKITAVHYRTPNSTPPSAGQALKTSLSPPQGAKLKTDLLILAAGSWSPQLARMAGEYLPLMPGKGYSMTVDNPAKKLRYPCILLEAKVALTPWANRLRIGSTMEIGPINDRILFPRVQGILEAVPRYLPGFLDDPEYRALADLDALRQNLREKVWFGFRPVSADGMPYIGYARKNANLIIATGHAMLGVSLAAGTGKLVAELADGQGTTVPAQAFDPCRY

SEQ ID NO: 495 - DNA, 1254 bp, Unknown
  Obtained from environmental sample
atgaccgaaaccatcacggaaagcgaaatcgtcgtacttggcgccggcatggtcggcgccgcgacggcgttggagcttcagcgccggggccgccaggtgacactcctcgaccgcaaggcgcccggcgaggagacgtcttacgggaatgccggcgttatcgagggcggcccctatgtgcctctcgcctttccgcgggatccgcgggagattctgcgctttgccggcaatcgccagacggcgcttcatttccattggcgctttctgccccggatcgccccctggctgttcgcgttgttcagcaattcggccgaaccccggctgcgcgagaacggcgcggccatccaatcgttgacggcgcacgcgcccgcaatgcatgaggccttgctgatcgaggccggcagggcggacctgttgcgcaagacaggctggctacagctttacgcgagcgatgccgcattcgccgccgatagcctgaaacggcgtatcgccgatgaggcaggatgcgactattcggtgctcgacactgaagccgccaaggagctcgagccccatctttcgccagcgttccacaaggcggtttactggccgtcgatccgatcggtcgccgatccaggcgcggcaacgaaggcggtggccgaactctttgcagggcagggcggccgcatcgcccggatggaggttctggcggtcgagccgttagcgggcggatggcgcgtgaaaaccgggcaggcggagattgccgcgcggcacgtcgtgatcgctctcggcccgtggtcgatggacctgttgcgcccgctcggctaccgcttcccgctggccgtcaagcgcggctatcacctgcatttccgggccaaggggaatgccaccctgtcgcggccggtggtcgacctatccaatggctttgtgatcaccccgatggcgcaaggtatccgcttaacgaccgggatcgaattcgctcatcgcgatgccccgctcacgccggtccagatcgcgcgcgccgagatcgcggcgcgtaggctctttccgctcgaagcgcccgtcgacccggaaccctggatgggccggcgtccgtgcctgccagactcgcgacccattatcggacctgcgccgcgccatgacggattgtggctgaatttcggccatgcccatctcggctataccctgggcccggtctccgcgcggctactggccgagttgataaacggagattcgccgatcagcgatccggcgccattcgccccgacgcgtttctga

SEQ ID NO: 496 - protein, 417 aa, Unknown
  Obtained from environmental sample
  DOMAIN (9)...(399): FAD dependent oxidoreductase
  SITE (291)...(294): N-glycosylation site. Prosite id = PS00001
MTETITESEIVVLGAGMVGAATALELQRRGRQVTLLDRKAPGEETSYGNAGVIEGGPYVPLAFPRDPREILRFAGNRQTALHFHWRFLPRIAPWLFALFSNSAEPRLRENGAAIQSLTAHAPAMHEALLIEAGRADLLRKTGWLQLYASDAAFAADSLKRRIADEAGCDYSVLDTEAAKELEPHLSPAFHKAVYWPSIRSVADPGAATKAVAELFAGQGGRIARMEVLAVEPLAGGWRVKTGQAEIAARHVVIALGPWSMDLLRPLGYRFPLAVKRGYHLHFRAKGNATLSRPVVDLSNGFVITPMAQGIRLTTGIEFAHRDAPLTPVQIARAEIAARRLFPLEAPVDPEPWMGRRPCLPDSRPIIGPAPRHDGLWLNFGHAHLGYTLGPVSARLLAELINGDSPISDPAPFAPTRF

SEQ ID NO: 497 - DNA, 1263 bp, Unknown
  Obtained from environmental sample
atgacccaagatgttctcgttctcggtgctggtatcgttggcgtatcgactgccattcatcttttgcggcgcggccgttcggtggttcttgtcgacagggccgatccgggcaaggagacctcgtttggcaatgccgggattatccaacgcgaaggcgtgaggccacatgcgtttcctcgcgatcttgcgaccttggttcaggtcggtatgcacttgagcactgccgcgcgctacgatccgctggccctgcccagattcgcgccagcgctggcgcgttattggtgggagtccgcgcccaaccattacaagcgtatcgtcaagagctacgccccgctgattgcccgttccatcgatgaacatgccgatttcattgccgctgcaggcgttgaagaccttatcgtgaaaaagggctggctccttgcctatcgcaccgacaaggctttgggcgaagcgctggaaaacgcgcgcatggatttcgagctttacggcatcaaccaccgcgtcgtggagccgagccaattggcaagcctggaaccgcacctgaaagtcaagatggccggtgccgtacactggacagacccctggaccgtcaagaatcccggcgcactggtcgcggcttatgccgagcttttcaagtccatgggcggcaagatcgtcacaggcgaggcccagcgcctagattcagggaaagatgaatggtcacttgtcctcaaggatcagaccgtcacagcaagagaagctgtcgtgacacttggtccatgggcaccggaatttctggagccgctaggctaccggctgccgcttttcgtcaagcgtggctatcacatgcactacagcacacaaggcaatgcagtgctcaacaactggctgctcgacgccgaagtggggtatctgctcgcgcccatgcagaatggcattcgtctcacgacaggagccgaatttgcgctgcgcgattcagcgcccacacccgtccagcttggcaaggccgagcgcaaggcacgcgatcttttcccgctggacaagcaactcgatcccaacccgtggaagggcgcccgcccctgcacgccggacatgatgccgatcatcggaccggcaacaaagcataaggggttgtgggtagcgatcggacatgcccatcatggctttacccttgggccagcaaccggccgggtgctggcggaagccatgaccggcgagcaaccggtcatagacatcaagcccttctcgatggaacggtttaccggcaattcgatcaggaattaa

SEQ ID NO: 498 - protein, 420 aa, Unknown; identical to SEQ ID NO: 488
  Obtained from environmental sample
  DOMAIN (4)...(395): FAD dependent oxidoreductase

SEQ ID NO: 499 - DNA, 1245 bp, Unknown
  Obtained from environmental sample
atgaaattcgacgtcgccgtgcttggcgcgggcattgtcggcatctcgacggccctgcatttgcaggcgcgcggcgcttccgttgcgctggtcgaccggcgcgggccgggcgaggagacgagcttcggcaatgccggcatcatccagcgcgagggcgtgcacccctatctcttcccgcgcgactggcggcggctcgcgcgcaccgcgctggggcgagggacggaggcgcgctaccagactgcctcgctgccgcatgtggcgggcttcctgtggcgctactggcgcgcctcggcgcccgagcaggcgcggcgcacgctggccgccaacatccccctgttcgagcgttgccttgtcgagcatggcgaactggcggaggcgtcgggggccggaaacctgatcgcaaaaggcggctggatcggattgttccggcagatggagcgggcgcgccgggccgagccagagattgccgaactgaagagcatgggccttgacgtggcgatgctgacgccgggcgagttcgccaggcttgagccgcatgtcgcgaccgaaaggctggcggcggcggtgcactaccgtgacccgtggacggtcagcgatccgggagcgctctcgaaagcctatgccgcgctgtttgcggcgcggggcggcaaaatggtcaccgccgacgcgcgcacgacgcgacgcgatggccaaggatggaagatcgacggcgcggagccggtcgaggcgcagcgcatcgttgttgcgctggggccgtggtcgaagccgttcctcgacatgcacgggctgcgcctgccgatgggcgtcaagcgcggctatcaccgccactaccggccggggccgggcgcgggattgaaccggccggtcatcgacgaggaggcgggcttcgttctcgcgccgatggcgcgcggcataaggctcaccaccggggcggagttcgccgcgctcgacgcgccggcgcgccccgttcaggtcgagcgctgcctgccgattgcgcgccagtggctcgatctcgccgacagtccggacgcgcaggcatggctcggggcgcggccggcatttcccgacctcctgccggcaatcgggcaagcgccgggcttgcccggcgtcttcctcaatttcggccatgcccatcacggactgacgctcgggccggcgacgggccgcctgctcgccgagatcatgagcgggcagacggctttcaccgaccctgcgccgtatggcgcggggcggttttcaggctga

SEQ ID NO: 500 - protein, 414 aa, Unknown
  Obtained from environmental sample
  SIGNAL (1)...(23)
  DOMAIN (4)...(394): FAD dependent oxidoreductase
MKFDVAVLGAGIVGISTALHLQARGASVALVDRRGPGEETSFGNAGIIQREGVHPYLFPRDWRRLARTALGRGTEARYQTASLPHVAGFLWRYWRASAPEQARRTLAANIPLFERCLVEHGELAEASGAGNLIAKGGWIGLFRQMERARRAEPEIAELKSMGLDVAMLTPGEFARLEPHVATERLAAAVHYRDPWTVSDPGALSKAYAALFAARGGKMVTADARTTRRDGQGWKIDGAEPVEAQRIVVALGPWSKPFLDMHGLRLPMGVKRGYHRHYRPGPGAGLNRPVIDEEAGFVLAPMARGIRLTTGAEFAALDAPARPVQVERCLPIARQWLDLADSPDAQAWLGARPAFPDLLPAIGQAPGLPGVFLNFGHAHHGLTLGPATGRLLAEIMSGQTAFTDPAPYGAGRFSG

SEQ ID NO: 501 - DNA, 2334 bp, Unknown
  Obtained from environmental sample
aaagaattcggcacgagcggcgtcggcgaggcgatggatatcgaaatgctccagggcatggctcccgcgcaggctgccgccgttcgcgccgaagtcgccctagacggcgggcgtgtcgtcctgtacacccccgccgtgcgtgacgaagacttcgacgtggccatcagctacctggtgcgtcgcctcgaagaaaacgccgcctcgcagaacttcctccacgcccagttcgctggcggccagggcgccatcgcaggccaggaggccgctttccgtaccgccgtcgctgctgccgttccgttcgcgccagaggccatcgccccgcgccgcaccccgcgctcgcagtggccgaatattgccgacgagatcgccgccgatggggtgttccgcaactccatcgacaccgaccctgccgtagctgcgcaccgaaacggcgccgccatcattatcgaccgtgaacagtccgggtacaagcctgttcagacgctgatgacgacggacgctgagactatcgacgctgcgctcacccgatccgtcgccgttcagcaggtatgggcagccgtgcccgctgccgcccgcgccgaggcgcttcacgccatcggacgtcgtttggaggccgcccggttcgacctcgtcgctgccgaagttcacgaggctggcaagacggtcgcagaagcagacccggaggtgacggaggccatcgacttcgcccactactacgctggctccgcgctcaccctcgacggggtgacaggcgcgaacttcacacccgacggagtcacgctcgttaccccgccgtggaacttccccgtcgccattcctgcaggcggtgtgcttgcggcgctcgcggccgggtcatccgttatcgcgaaaccggcttcgccgaccccgcgctgtttcgaacttgtcattgaggccgttcacgctggtcttgacgatgcgtcggcgacgaccggcttaacccctgagcagaaccgcgacatcgtccagtttattcgcgtctccgagcggtcgcttggtaagcagttggtcacccatgatgcggtggcccgcgtcatcctcaccggctccatcgagacagcggaacttttcgcgtcgtggaagcccgagcgtcccgtgcttgcggaaacctccgggaaaaactccatcattgtcaccgcgtcctccgacatcgacctggccgtcgctgacgtgctgcggtccgccttcggacatgccgggcagaagtgctccgctgcttcgttggcgattctcgtcggctccgtcggcgacccgaagtctgcgacgggcgaacgcttccgccgtcaactcatcgacgccgtgaagtccctggccgttggcgcaccgaccacgctgtccactgtcatgggtccgctgaccgagcctgctggtgagaagttaacccgggcgctgaccacactcgagccgggggagacgtggctggtcaagcccgaacttcttgacgagcaggcggctgccgcaggcctcggtgaaaaccgcctgtggacgcctggcctgcgcgacggtgtcaagcccggttcatggttccacctcaccgaagcgtttggtccggtgctcggcctgatgacggcccgcacacttgaggaggctatcgagttacagaacgccaccgcgttcgggctcaccgccggcctgcactccctcgacgacgatgagatcgccctgtggaaggaccgcgtccaagccgggaacctctacatcaaccgccacatcaccggtgctatcgtccagcgtcaaagcttcggaggctggaaggcctcgtcggttggccccggcgcgaaggctggcggtccccactatgttgcgatgctcggccagtgggccgacgctgccgatgtcccctcgcgcgatactgactcggctgcgtggttggagtgggcgaaggccgatgacacccgcgtgtgggcgcagttgtcgaaggaggtcgacttgtctgggctcgtcagcgaggagaacaccttccggatgcgtcccatcgacgcgctgaccatccgcgttggtgacggcgcactgcccgtcgaggtggagcgtgtgcgcaacgccgcctggacggcaggtgttgagtccgtcgtgatcccagttcacgacatgacacacgaagtcttcgccgccgccgtcgcgtctggtgacatctcaggccgcatccgcgttatcggcgcagcgcctggcctacacgaggccgccgcgacggttctcggctcaacgacggtgctcgacgccccggttgtcgcctcgggtgcccgcgaactgctcaacgtgctccgtgaacaggccgtcagccgcaccaaccaccgttatggccacattaagcactga

SEQ ID NO: 502 - protein, 777 aa, Unknown
  Obtained from environmental sample
  DOMAIN (148)...(613): Aldehyde dehydrogenase family
  SITE (131)...(134): N-glycosylation site. Prosite id = PS00001
  SITE (408)...(419): Aldehyde dehydrogenases cysteine active site. Prosite id = PS00070
  SITE (549)...(552): N-glycosylation site. Prosite id = PS00001
KEFGTSGVGEAMDIEMLQGMAPAQAAAVRAEVALDGGRVVLYTPAVRDEDFDVAISYLVRRLEENAASQNFLHAQFAGGQGAIAGQEAAFRTAVAAAVPFAPEAIAPRRTPRSQWPNIADEIAADGVFRNSIDTDPAVAAHRNGAAIIIDREQSGYKPVQTLMTTDAETIDAALTRSVAVQQVWAAVPAAARAEALHAIGRRLEAARFDLVAAEVHEAGKTVAEADPEVTEAIDFAHYYAGSALTLDGVTGANFTPDGVTLVTPPWNFPVAIPAGGVLAALAAGSSVIAKPASPTPRCFELVIEAVHAGLDDASATTGLTPEQNRDIVQFIRVSERSLGKQLVTHDAVARVILTGSIETAELFASWKPERPVLAETSGKNSIIVTASSDIDLAVADVLRSAFGHAGQKCSAASLAILVGSVGDPKSATGERFRRQLIDAVKSLAVGAPTTLSTVMGPLTEPAGEKLTRALTTLEPGETWLVKPELLDEQAAAAGLGENRLWTPGLRDGVKPGSWFHLTEAFGPVLGLMTARTLEEAIELQNATAFGLTAGLHSLDDDEIALWKDRVQAGNLYINRHITGAIVQRQSFGGWKASSVGPGAKAGGPHYVAMLGQWADAADVPSRDTDSAAWLEWAKADDTRVWAQLSKEVDLSGLVSEENTFRMRPIDALTIRVGDGALPVEVERVRNAAWTAGVESVVIPVHDMTHEVFAAAVASGDISGRIRVIGAAPGLHEAAATVLGSTTVLDAPVVASGARELLNVLREQAVSRTNHRYGHIKH

SEQ ID NO: 503 - DNA, 1263 bp, Unknown
  Obtained from environmental sample
atggtgaaacagggcaagggtcccaccgttgtcatcggcggcggcgtcattggggcgatgtgcgcttggtacctgtcaaagactggttacgacgtcacgatcgtcgaccgcggcctgtttgcatcggggtgttcccacggcaattgtggttacatcagccccagccatattctgccgttgaccacgccgggcgcggtacgaatggcgctcaggtcgatgatctcgagcgagtcccctttttacgtaaagccccgtttttctccggcgatgtggcaatggatgtggcgattcgcgcggcgctgtaatgaacgggacatgttggaagccgccgacgtcttgcatccgctgctgcaatccgccaagcaactctatatcgaattgattgagggtgagcggctcgattgcgaatggcaggacacggggatcattttcgttttccagagcgaacacggttttcggcactacgaacaaatcgactccctgttgggaaagcgttacggcgtctccgccaaaccgttggacagccggcaactcgcggcgttggatccggctttaaaccccggtctgggcggcggatggttttacgagtgcgacgcgcatttacggcccgataaactaatggcggaaatgaaacgcaaactcgtcgaacgcggcgtggaaatccttgaaaaccaaccggtcgagagctttgtcgtcgaagcgggccgcgcccgttcggtgctgacgtcgcaaggcgaaattgaaggcgctcaattcgtcgttgccacgggttcctggacgccgtttctcaatcgatatttggggcgccgcgtcccgattcagccgggtaaaggctattcgttgacgatgccgaggccgactctatgccccaagtattcgatgattttcgaggaacatcgcgtcgcgatcacgccgatgatgagcaaatttcgcatcgggtcgacgatggagttcgcgggatacgacacgacgatcaatccacgcagaattgcattgctgaagaaagcggccaagctgtacttgcgcgaaccccatttggatcttgtcgaagagacctggtacggctggcggccgatgacttgggacagcaagccgttcattgatcgcgctccggcgatgagcaacacttgggtggccgcggggcataatatgcttggactctccttggctacggtgaccggcaaattgatcgccgaactcgtcaacggcgatcggccacacctcgacgtgaaaccgcttagtttcgcccggctcatggattga

SEQ ID NO: 504 - protein, 420 aa, Unknown
  Obtained from environmental sample
  DOMAIN (8)...(400): FAD dependent oxidoreductase
MVKQGKGPTVVIGGGVIGAMCAWYLSKTGYDVTIVDRGLFASGCSHGNCGYISPSHILPLTTPGAVRMALRSMISSESPFYVKPRFSPAMWQWMWRFARRCNERDMLEAADVLHPLLQSAKQLYIELIEGERLDCEWQDTGIIFVFQSEHGFRHYEQIDSLLGKRYGVSAKPLDSRQLAALDPALNPGLGGGWFYECDAHLRPDKLMAEMKRKLVERGVEILENQPVESFVVEAGRARSVLTSQGEIEGAQFVVATGSWTPFLNRYLGRRVPIQPGKGYSLTMPRPTLCPKYSMIFEEHRVAITPMMSKFRIGSTMEFAGYDTTINPRRIALLKKAAKLYLREPHLDLVEETWYGWRPMTWDSKPFIDRAPAMSNTWVAAGHNMLGLSLATVTGKLIAELVNGDRPHLDVKPLSFARLMD

SEQ ID NO: 505 - DNA, 1266 bp, Unknown
  Obtained from environmental sample
gtgagtcgtcgagctatcgtcgttggcggaggcgtgatcggtgcaggatgcgcgcattatctgaccgaatctgattggcaagtgacgattgtcgaacgaaagacgttcgggtgcggagcatcgcacgcgaattgcggtctgatttcgccgagccacatccttcccttgcccggcccaggtgtcattggcaagacaatgaaggcgatgtttagcccgaattcgcctttctcaatcaaaccacggcttgatccggcgctgtggagttggctgctccagttcgctcgccattgcaacatgagcgatttcattcgcggcggtaaaactctgcaagcgatgctgaattcctcgcgttcgctttacgatgatctcttcgccaataatccgctcgacgccgaattccagcacgccggtgtcctttttccctttctgagcaaagcagggatggaacacttcggcgagaacaatcaacttcttcgcgaacactttggagcgggcgcccaacgatacgatggtgacgatgtttcgaagctcgaacccgccttgaaaaccggcttggctggcggttggtatttctcagaagacgcgcacttgaagcctgacaaactgatgtcctcttggcgcaaagtgctggagtcgcgcggcgtaacagttctcgaaaatcgagagatcaccggcttcggcaaacaggatcccaatggcgccgccggcaatcgaaaagtcaccaccgtaaagacgccccaaggcgaaatcgaaggcgatgtcgtcgtggtcgcgactggagcctggacgccgttgctgaattccgagctcgaatgcaaggttccgattcaacccggcaagggctattcgctgacgatggctcgaccgtcgatctgcccgaagattccgatgatcttcgaggaacaccgtgttgcggtcactccatggccgtccggttatcggttgggttcgaccatggagtttgctggctatgattcgaaactgaatccgcgccgcatcatgttgctcagaaacggtgccagccattacctgcacgaaccgactgcggaacccgttgtcgaagaatggtgtggctggcgaccaatgacccctgatagcctgccgattatcgatcgatgcccagcctttgataacgtattcttggcggccggccacaacatgctaggtgtctccatggcgccggtaaccggaaagctgattgccgaactgatcaacggaaaaactccccacttgccgatcgaaccgatgtcgatcaggcgattttga

SEQ ID NO: 506 - protein, 421 aa, Unknown
  Obtained from environmental sample
  DOMAIN (4)...(403): FAD dependent oxidoreductase
  SITE (36)...(42): Immunoglobulins and major histocompatibility complex proteins signature. Prosite id = PS00290
  SITE (99)...(102): N-glycosylation site. Prosite id = PS00001
  SITE (115)...(118): N-glycosylation site. Prosite id = PS00001
MSRRAIVVGGGVIGAGCAHYLTESDWQVTIVERKTFGCGASHANCGLISPSHILPLPGPGVIGKTMKAMFSPNSPFSIKPRLDPALWSWLLQFARHCNMSDFIRGGKTLQAMLNSSRSLYDDLFANNPLDAEFQHAGVLFPFLSKAGMEHFGENNQLLREHFGAGAQRYDGDDVSKLEPALKTGLAGGWYFSEDAHLKPDKLMSSWRKVLESRGVTVLENREITGFGKQDPNGAAGNRKVTTVKTPQGEIEGDVVVVATGAWTPLLNSELECKVPIQPGKGYSLTMARPSICPKIPMIFEEHRVAVTPWPSGYRLGSTMEFAGYDSKLNPRRIMLLRNGASHYLHEPTAEPVVEEWCGWRPMTPDSLPIIDRCPAFDNVFLAAGHNMLGVSMAPVTGKLIAELINGKTPHLPIEPMSIRRF

SEQ ID NO: 507 - DNA, 1254 bp, Unknown
  Obtained from environmental sample
atggccgaacacaaggctgacgttctcgtgctcggtgccggcatggtcggtgtcggcgccgcgctgcacctgcaacggcgcgggcgcgacgtcatcctggtcgaccggaatgagcttgcgggcgaggggacgagctacggcaatgccggaatcatcgaatgcgcctcggtattcccctacatgtttccccgcgatgtcggggaaattctctattatgcgaccaatcgcgcgccacacgtccgttatcggctcgccgacctgccgtcgttcctgccctggctcctgcgctattatctcgcttccgagccgtcgcgtgccttgcgcggcgcgatgggcgtgctgccgctgatccggcgcagtctcgtcgaacatgaggcgctgatcgcggaagccggcgtgccggagctgctgcgcaaggacggctggatcaagctgttccgatcagcgaaaaccatggacaaggccatcgccgaactggaacgggcgcgacaatatggcgtagagggcgatgtcctcgatgccgctggtatcgccgcgcgcgagccgcatcttgccggcgatttcaccgctgccatccatttcacccagccggggttcgtgcccgatcccggcgggctcgccaagggctatgccgcgctgttcaagcgcaagggcgggcgtttcctggtggcggatgcgaccacgctcgaaccggcgggcaatggctggcgcgtgagcggggcgggcgacagcgcggtggcgcacgaggcggtgatcgcgctcggcccatggtccgatctggtgttcgagaagctcggctatgccctgccgttctcggtcaagcgcggctaccatctgcatctggcgccgcgcggcaacgccgtgctgcggcgtcccgtgctcgatgccgaccagggtttcttgctggcgccgatgaaccgcggcattcgcctgaccaccggcgtcgaattcgcccgccgcgacgcgccggagaatttcgcgcaggtcgaagccgcgctgccgaaggcgcatgcgctgtttccgctcggcgaggcggtggatgcaaagccgtggaagggcgcgcgcccgtgcctgcccgacatgctgccggtcatcggcaaggcgccgcgccatccgggattatggttcgacttcggccatcagcatcacggcctgacgcttgggccggtgacggggcgcctgctcgcggagatgatgacgggcgaaacgccgttcgccgaccccgcgccgttttcgccggacaggtttgggtaa

SEQ ID NO: 508 - protein, 417 aa, Unknown
  Obtained from environmental sample
  DOMAIN (7)...(398): FAD dependent oxidoreductase
MAEHKADVLVLGAGMVGVGAALHLQRRGRDVILVDRNELAGEGTSYGNAGIIECASVFPYMFPRDVGEILYYATNRAPHVRYRLADLPSFLPWLLRYYLASEPSRALRGAMGVLPLIRRSLVEHEALIAEAGVPELLRKDGWIKLFRSAKTMDKAIAELERARQYGVEGDVLDAAGIAAREPHLAGDFTAAIHFTQPGFVPDPGGLAKGYAALFKRKGGRFLVADATTLEPAGNGWRVSGAGDSAVAHEAVIALGPWSDLVFEKLGYALPFSVKRGYHLHLAPRGNAVLRRPVLDADQGFLLAPMNRGIRLTTGVEFARRDAPENFAQVEAALPKAHALFPLGEAVDAKPWKGARPCLPDMLPVIGKAPRHPGLWFDFGHQHHGLTLGPVTGRLLAEMMTGETPFADPAPFSPDRFG

SEQ ID NO: 509 - DNA, 1245 bp, Unknown
  Obtained from environmental sample
atggcacgtaccgatgcaattgtgatgggcgccggcattgtcggtacatcgatcgcgctgcatctggtcaagcggggcctctccgttgcgctgatcgatcgcgccggcattggcgagcaaacgtcctacggcaattctggcgtgatcgagggcagcacgattctgccgccggcattcccgccgggtctgagcgggctcctgcgcgcggcgttcaagcgcggcagcgacgccaactaccatttcggctttctgccgcaggtggcgccgtggctgtgggcgtttcgcgcagcatcgcggccggacaggcttgccgaaaccgcgcggctgaaccggccgctgtttgccgccgccattcccgagcacgaagcgctgatgctcgagtccggcgcgacgaagtacctgcgtaagaccggatggctcaagctctatcgcaacgaggcgagcttcaacgccttgcaggcggaattcgaactggcgaaggagtttggattgccgctcgaggcgctcgatgcggaaggcgtgcaggcgctggagccatcgctgcgtcccgtgtttgcgcgcggcgtgttctggccgaaggccgcgagcctgagcaacccgctggccgtaacgcgtgcttatgccaaacgttttagcgatctcggcggtctgacgctgaccggcgatgtacgcacgctgcatcgctccggttccggctggcgcgtcgaaaccaacgagggcggcgtcgatagcgcgaatgtgatcgttgcgcttgggccctgggcgcccgatctgctggagccgctcggcatccgcctgccgatgaaattcaagcgcggctatcaccagcatttcaaggcggagggcaatgcgtcgctggcgcggcccgttgtcgatgtcgccaacggctatttgatcacgccgatggagcagggcattcgcctgacgacgggcgccgaattcgccgcgcgtgatgcggcaccaacgcctgtgcaattcgaccgcttgatgccggcggcgcgcggcctgtttccgctcggcgagcgcgccgacgacaagacctggctcggcgcgcggccgtgcttcccggactcgcgtccagtaatcggcaaggcgccgggacagagcggcctatggctcgcgatcggccacgctcattgggggctgacgcttgggccgccgaccggacggctgatcgccgatatgattgaaggcaagacgcccttcgtcgatccgaagccttacgcggcagagcgtttcctgtag

SEQ ID NO: 510 - protein, 414 aa, Unknown
  Obtained from environmental sample
  DOMAIN (5)...(395): FAD dependent oxidoreductase
  SITE (287)...(290): N-glycosylation site. Prosite id = PS00001
MARTDAIVMGAGIVGTSIALHLVKRGLSVALIDRAGIGEQTSYGNSGVIEGSTILPPAFPPGLSGLLRAAFKRGSDANYHFGFLPQVAPWLWAFRAASRPDRLAETARLNRPLFAAAIPEHEALMLESGATKYLRKTGWLKLYRNEASFNALQAEFELAKEFGLPLEALDAEGVQALEPSLRPVFARGVFWPKAASLSNPLAVTRAYAKRFSDLGGLTLTGDVRTLHRSGSGWRVETNEGGVDSANVIVALGPWAPDLLEPLGIRLPMKFKRGYHQHFKAEGNASLARPVVDVANGYLITPMEQGIRLTTGAEFAARDAAPTPVQFDRLMPAARGLFPLGERADDKTWLGARPCFPDSRPVIGKAPGQSGLWLAIGHAHWGLTLGPPTGRLIADMIEGKTPFVDPKPYAAERFL

SEQ ID NO: 511 - DNA, 1266 bp, Unknown
  Obtained from environmental sample
atgactgaagcttccagaacttcccgccagaccgaagtgatcgtgctcggcgccggcatcgttggcgtttccacggcactggccctgcaacagcgcggccatgccgtgtgcctgatcgaccgcagcgcgccgggccgcgagacttcgtatggcaatgccggcatcatccagcgcgaagcggtccagccctacgcatttccgcgcgcctggcaggcgatcctgcgcgtggcggcccggcgcggcaacgacgtgcactaccacctgcgtgcgttgccgtcgctggtgccgttgctggcgcgctactggcacgcatcggcgcccgagcgctatgtggcgacggtcagcgcctatgcggcactgatccgacactgtatcgacgagcacgcaccgctgatcgagcgcgcgggcgcacaggacctgatccgcaagtctggctggctggaggcttaccggacgccggccgcattcgaggcggcggtgaaggaggcgaacaccgtcgcggcggcgcaccagttgcgtcacgcaatcctggacagcgcggcgctggccgccgcggagccggtgctgcaacgtccgatggccggcgcggtgcactggcaggacccgtggaccgtcagcgatcctggcgagttggtggcccgctatgcggcgctgttcgagcgggaaggcggggtgttgctgcaaggcgatgccgatacgcttcgccaggcgggtagtggctggacggtgcgcacgcgtgacggtgccgttgacgccgaacatgccgtgatcgcactgggcccgtgggcggcggggctgacgcgccggcttgaataccgcctgccgctgttcgtcaagcgaggctaccatcgccactaccaggtcgatgcgatgccggccatgccgctgctcgatgccgagaacggcatcctgctggcgccgatgcgccagggcctgcggctgacgacgggcgccgaattcgcgcatcacgaggccccgcccacgccggtgcagtcgatgcgcgccgaaatgctcgccagcgatctggtgcggctgggcaagccggtggaagcgcagccgtggatgggggcgcggccctgcatcgccgacatgcgccccgtggtgggccaggcgccgcaccacgctaacctgtggttccatttcgggcacggccaccaaggcctgacgctggggcccgccacggcacggctgctggccgaactattcgatcgcgaagcgccgtacgtcgaccccgcgccgtatgacccccgccgcttcggccgctaa

SEQ ID NO: 512 - protein, 421 aa, Unknown
  Obtained from environmental sample
  SIGNAL (1)...(28)
  DOMAIN (12)...(401): FAD dependent oxidoreductase
MTEASRTSRQTEVIVLGAGIVGVSTALALQQRGHAVCLIDRSAPGRETSYGNAGIIQREAVQPYAFPRAWQAILRVAARRGNDVHYHLRALPSLVPLLARYWHASAPERYVATVSAYAALIRHCIDEHAPLIERAGAQDLIRKSGWLEAYRTPAAFEAAVKEANTVAAAHQLRHAILDSAALAAAEPVLQRPMAGAVHWQDPWTVSDPGELVARYAALFEREGGVLLQGDADTLRQAGSGWTVRTRDGAVDAEHAVIALGPWAAGLTRRLEYRLPLFVKRGYHRHYQVDAMPAMPLLDAENGILLAPMRQGLRLTTGAEFAHHEAPPTPVQSMRAEMLASDLVRLGKPVEAQPWMGARPCIADMRPVVGQAPHHANLWFHFGHGHQGLTLGPATARLLAELFDREAPYVDPAPYDPRRFGR

SEQ ID NO: 513 - DNA, 1266 bp, Unknown
  Obtained from environmental sample
atgaaagtcatcgtcttgggagcaggcatcatcggtaccgcatccgcctggtatctgcagcaggccgggcacgaagtgcaggtgatcgaacgcgccgccggtgctgcgctggaaaccagtttcgccaatggctgccagatttccgtttcccatgccgaaccctgggctaacccgtcggccccgctcaaggtcttgcaatggctggggcaggaagatgcgccgctgctgtatcgcttccgccccgaatggctgcaatggaaatgggcgctgtccttcctgcgcgaatgcacgccggcgcgcaccgctgccaatatccgccagatcgtcgcgctggccgaatacagccgtcaatcgctggtggcgctgcgccaggaaagcgggattgcctacaacgagctgacacgcggcatcctgcacttttacaccgaacaaaaggaattcgacaactcgctgccgatggccaaactgatgcgcgacctgggttgcccgcgcgaaagcatcagcgccgcgcaggtggtgcagctggaaccggcgctggctggcatccgcgacaagatcgttggcggcgactttaccgccaccgacgaatcgggcgatgtgtatcaattcaccagtggtctggcggccagggccgccgccgccggtgtcgatttccagtatcagacccagatcacgcgcctgctggtggaaggcaccggtgccgccgccaaggtgacggcggtcgaagtgatcgggccggatggccgccatcgcctgctgcaggcggatgccttcgtggtggcgctgggcagttattcgcaggcgctgctggccccgcatggcatcgacctgatgatttaccccggcaagggctattcggcgacctaccgcgtcaccgatgccgacgctgcgcccaccgtctcgctgaccgatgatggctacaaaatcgtcatctcacgcctgggcgaccgcctgcgcgtggccggcacctgtgaattgaacggttttggacgcgaactgaacccgacccgctgcgccgcgctgacgcgccgcacgcgcgagctgttcccgaccgcctgcgactatgacaatccggtgtactggaccggcctgcgcccgctgacaccatcgaatgtgccctatgtcggcaagagtaaaatcggcaatctgttcttgaacaccgggcacggcacattgggctggaccatgggctgcggctcgggccgggcactggccgacatcatcagccagcgcgtgccagaagttgattttaccttctcgtgccga

SEQ ID NO: 514 - protein, 422 aa, Unknown
  Obtained from environmental sample
  DOMAIN (2)...(407): FAD dependent oxidoreductase
MKVIVLGAGIIGTASAWYLQQAGHEVQVIERAAGAALETSFANGCQISVSHAEPWANPSAPLKVLQWLGQEDAPLLYRFRPEWLQWKWALSFLRECTPARTAANIRQIVALAEYSRQSLVALRQESGIAYNELTRGILHFYTEQKEFDNSLPMAKLMRDLGCPRESISAAQVVQLEPALAGIRDKIVGGDFTATDESGDVYQFTSGLAARAAAAGVDFQYQTQITRLLVEGTGAAAKVTAVEVIGPDGRHRLLQADAFVVALGSYSQALLAPHGIDLMIYPGKGYSATYRVTDADAAPTVSLTDDGYKIVISRLGDRLRVAGTCELNGFGRELNPTRCAALTRRTRELFPTACDYDNPVYWTGLRPLTPSNVPYVGKSKIGNLFLNTGHGTLGWTMGCGSGRALADIISQRVPEVDFTFSCR

SEQ ID NO: 515 - DNA, 1242 bp, Unknown
  Obtained from environmental sample
atgcagtctattgcagtcatcggcggtggaatcaccggcgtcacttccgcttatgcccttgctaagcgtggttatcaagttaccctttttgaaaagcagcgctatgcagcgatggaaacctcttttgccaatggtggtcagctttcggcctctaatgcagaagtttggacctgctggtcgactattctcaaaggattaaagtggatgctaaaaaacgatgcgccgctgctcgtaaatcctaagccatcttggcataagttcagttggtttgctgaatttatcgcttctatacctcagtatgaaaacaatacgaccgagacagcgcgtatggcgattgccgcgcgtgagttattgtttggctgggctaaagaagaaaatatcgatttcgatcatgtcgagaaaggaatattgcatatttatcgagataaagctggctttgagcatgctcaaaaagtttctcaattgctagctaaaggtggtttggtgcgcgaaacgctttctccaagtgacattcagcgaatcgagcctacgctaaaagggagttactacggtggctttttaacacccagtgatactaccggtgatatccataaatacacccaaggtttagccagagcctgtgagcgtttgggtgttaactgtctgtatgagcaagaagtgttggaagttaaggctgatgatcgtgaagctagggtaattgttaattcagtagaaggctcgattagccatcaattcgatgcggttgtggtatccgctggtgtggccagtcggaaactagcggcatcacttggcgatagagtcaatatctatccggtgaagggttattccattacggtcaatttgttagatgagcaaagccaagcagctgcgcctatggtgagtttattggatgatgagactaaattagtgaccagtcgcttaggaaaagatcgtttccgcgtggcgggtaccgcagaatttaacggctacaacaaagatatcagggctgatcgtattaagcctttggtggactgggtgaatcaatgcttcccagatgtaaacacacgaagcgtggttccttgggcaggacttcgtcctatgatgcctaatatgatgccaaaagtgggtaagggtaaattacccaccgtgttctacaataccggtcatggccatttgggttggacgttaagtgcggtgacggctgatatgttagcggatgtgatcgatcaggctagcacctcggcacaatttgttcccgcttga

SEQ ID NO: 516 - protein, 413 aa, Unknown
  Obtained from environmental sample
  SIGNAL (1)...(21)
  DOMAIN (3)...(400): FAD dependent oxidoreductase
  SITE (103)...(106): N-glycosylation site. Prosite id = PS00001
MQSIAVIGGGITGVTSAYALAKRGYQVTLFEKQRYAAMETSFANGGQLSASNAEVWTCWSTILKGLKWMLKNDAPLLVNPKPSWHKFSWFAEFIASIPQYENNTTETARMAIAARELLFGWAKEENIDFDHVEKGILHIYRDKAGFEHAQKVSQLLAKGGLVRETLSPSDIQRIEPTLKGSYYGGFLTPSDTTGDIHKYTQGLARACERLGVNCLYEQEVLEVKADDREARVIVNSVEGSISHQFDAVVVSAGVASRKLAASLGDRVNIYPVKGYSITVNLLDEQSQAAAPMVSLLDDETKLVTSRLGKDRFRVAGTAEFNGYNKDIRADRIKPLVDWVNQCFPDVNTRSVVPWAGLRPMMPNMMPKVGKGKLPTVFYNTGHGHLGWTLSAVTADMLADVIDQASTSAQFVPA

SEQ ID NO: 517 - DNA, 1239 bp, Unknown
  Obtained from environmental sample
ttgaaaagtgtaattatcattggaggcggaattatcggattgtgttctgcatattacttggcaaaagaaggcgcccaagtaacagtaattgataaatctgatatggcggatggctgttcttatggaaatgcaggaatgattgttcccagccacattattccaatggcgcaacccggcgtaattcatcaaggaattaaatggatgtttaatgccaaaagtccattttacataaaaccggcttttagtctggatttgctagcctggctgattcaattttacaaaaattccaatcagaatcatgttgataaatcaatggttcctttgcgaaatctttcattcttcagcaaagaattgtatcaggaatttgcgcaatcggccaatgaatttgggtatcaggaaaaagggcttttgatgctctacaatactgaaaaagttggagaagaagaaatcaaaataggaaaaattgcagaagaattggggatagaagtcgattttttaaatcagatggaagttaaggaactggaaaaaaatattgctgtaaaagcgttaggtgccgtccattacaaatctgatgcgcatttgtcgccaaatcattttattgcctttttaaaatccgaattaaatcagatggacgtgaagttgatttccaattactccttaatcgattttaatgtttctgaaggaaaaatatcagaattattgaccaatcagggaaattttaaggcagatgaatttgtgatttccgctggttcttggagtgtggaagttgccaaaaaattgggagtaaaattgcatatattgcctggcaaaggatatagttttaatgtggaaaatcttttggaaaaaccaacaattccgtctattttatgtgaaggaaaagttgctgtaacgcctatgggcgaaagggtgcgatttggcggaactttggaaatcaccaacaataatgatactaaaatcaatattaaaagactgcagggaattgttgaaaaagtaaatcaattttatccacatatcaaagttggacttcctgataaagaaaaagtatggcatggttttaggccttgcacgccaaccggattgccaattattgagaaatccaataaaattaaaaatttgaccattgcaacaggccatgcgatgatgggtttgagtttggcgcctgcatctggcaaactggttagtgaattgattatgggtaaaaaaacatcggtggatattgccgaatttaggagttgttaa

SEQ ID NO: 518 - protein, 412 aa, Unknown
  Obtained from environmental sample
  SIGNAL (1)...(21)
  DOMAIN (3)...(396): FAD dependent oxidoreductase
  SITE (111)...(114): N-glycosylation site. Prosite id = PS00001
  SITE (220)...(223): N-glycosylation site. Prosite id = PS00001
  SITE (227)...(230): N-glycosylation site. Prosite id = PS00001
  SITE (319)...(322): N-glycosylation site. Prosite id = PS00001
  SITE (376)...(379): N-glycosylation site. Prosite id = PS00001
MKSVIIIGGGIIGLCSAYYLAKEGAQVTVIDKSDMADGCSYGNAGMIVPSHIIPMAQPGVIHQGIKWMFNAKSPFYIKPAFSLDLLAWLIQFYKNSNQNHVDKSMVPLRNLSFFSKELYQEFAQSANEFGYQEKGLLMLYNTEKVGEEEIKIGKIAEELGIEVDFLNQMEVKELEKNIAVKALGAVHYKSDAHLSPNHFIAFLKSELNQMDVKLISNYSLIDFNVSEGKISELLTNQGNFKADEFVISAGSWSVEVAKKLGVKLHILPGKGYSFNVENLLEKPTIPSILCEGKVAVTPMGERVRFGGTLEITNNNDTKINIKRLQGIVEKVNQFYPHIKVGLPDKEKVWHGFRPCTPTGLPIIEKSNKIKNLTIATGHAMMGLSLAPASGKLVSELIMGKKTSVDIAEFRSC

SEQ ID NO: 519 - DNA, 1251 bp, Unknown
  Obtained from environmental sample
atgcggatcgttatcattggaggaggcatcattggtttaagcagcgcttattatttgcaggcaggcggacatgaagtaactgtcatcgataaaacggatatgagcagtaactgctcttatggcaatgcgggatatgtttgtcccagtcattttacaccgcttgccacaccgggtattgtaaagcaagggctcaaatggatgtggaattctaaaagtcctttttatgtgcaaccgaggctaagtcgcagtttgatcaactggggcatgcaattcatgaaagccgcaacccaacagcacgtggaagactcagccataccgcttagggatattgcgatcctgagtaaaaaaatgtatgaagaatggacagcattaccgcagttcaacttcgcttatgagcacaaaggattgttagagattttccaaacgccggaaggtgcagaacatgccaaacacgtagtagagaaagcccgcgaactgggattgaccgatactgccttgctggattacgatgcattgcaggcgatggaaccccagacaaggatcaacgcgcagggcgctgttttctttcgttgtgatgcgcatctttatcccaacaaattgatgcagcaactgatagccgatttgaaacaaaaaggcgtgcgcatacaaacaaatgaagaagtgattcgttttgaaaatgccaatggaaatatcactcaactaattacaaccaatggcgcttaccatgcagatacggttgtgatagccggcggctcctggagccgtgaactggctgccaaaatgaatgtcagtataccattggtgcccggcaggggatattcggttaccctggaagattcaccttaccggctcaactatccggccatattggtggaaggcagggtggctatgacgccgatggatggcaacaagctgcgcatgggcggaaccatggaaattacttccacacaaacaccccctcgcctcaaaagggtgcagggcattctggatgcagtgaaaaagttttaccctgaattcaatgtgccaatgcctgctgccgataaaatatggtatggctaccggccttgctcggcggatgggttgccctacctggggcgcacccggcaatggaagaatgtggtgttggctacggggcatgccatgttgggactgagtttgggcgcaggaacgggaaaactggtgagtgaagttgtggatgagcgggaaacgagcatggacatccgcccattcaaccccgaccgtttttcctga

SEQ ID NO: 520 - protein, 416 aa, Unknown
  Obtained from environmental sample
  DOMAIN (2)...(397): FAD dependent oxidoreductase
  SITE (37)...(40): N-glycosylation site. Prosite id = PS00001
  SITE (233)...(236): N-glycosylation site. Prosite id = PS00001
  SITE (266)...(269): N-glycosylation site. Prosite id = PS00001
MRIVIIGGGIIGLSSAYYLQAGGHEVTVIDKTDMSSNCSYGNAGYVCPSHFTPLATPGIVKQGLKWMWNSKSPFYVQPRLSRSLINWGMQFMKAATQQHVEDSAIPLRDIAILSKKMYEEWTALPQFNFAYEHKGLLEIFQTPEGAEHAKHVVEKARELGLTDTALLDYDALQAMEPQTRINAQGAVFFRCDAHLYPNKLMQQLIADLKQKGVRIQTNEEVIRFENANGNITQLITTNGAYHADTVVIAGGSWSRELAAKMNVSIPLVPGRGYSVTLEDSPYRLNYPAILVEGRVAMTPMDGNKLRMGGTMEITSTQTPPRLKRVQGILDAVKKFYPEFNVPMPAADKIWYGYRPCSADGLPYLGRTRQWKNVVLATGHAMLGLSLGAGTGKLVSEVVDERETSMDIRPFNPDRFS

SEQ ID NO: 521 - DNA, 1254 bp, Rhodococcus erythropolis DSMZ 44522
atgggaactcgtcagagccccgatcgtgtggtcgtggtcggtgcgggtgttgtcggattgtcgacggcctggttcttgcaggaacgtggagtcgaagtcaccgtcgtcgatcgcgacggcgtcgcagccgacgcgagctggggcaacgccggttggcttgcccccgcattgacgcttccgctgcccgaacccgcagtgctccaatacggcttgcgcgcgatgctcagcccgtcgtccccggtgtacgtgccactgaccaccgatctgaagctgattcggttcctggtcgggttcgcgcgccactgcacgccgtcgaagtggcaggaagcgatgtcggtctacaccgaggtcaaccgaacagccttgggcgcgtacgacgaactcgccgacggtggcgtcaaagagctgacgcgcctggccgatcctttcctcgccgcgtttgcgtccgagaaggaccgacagaccttggtggacgagttccaccacgtcgaagctgccggcggagaagtcgacttcgacctcctcgactacgacgccattcattcgctcgagccttcactcggtcagggtgtgaaagccggtttgcgtctgcgcaatcagcgtttcatcgatcccccgttgttcgtgaactcgttggcggacgcggttcgtgaacgtggtggagaaatcgtcagcggtttcgacgtcacgcagatcgacgatcgggtcggcggagtcactgttcgcagtgcacacggtgattcacgcgacggcgacgccgtggtcatctcgagcggtgcccgcttgaacaagctcgcagcaccgttcggtgtgcgcaaactggtgcaggccggacgcggatacagcttcagtgtcaagcccgagcacctccccaagaaccctgtgtatttccccacccagcgcgtcgcatgcactccgttgcacgatcgcttccgagtggccggaatgatggaattccgcagccctgacgcgccgctggatccgcgccgcgtgcaggcgatcatcgatgcggccaagccgatgctcagcggcatcgactggactgcgcgggaagaggaatgggtgggatcacggccgtgcactaccgacggcttgccgttgatcggagccacgcgctcgccgcgcgtgcacgtcgccggtggtcacgggatgtggggaatcgccctgggtccgttgaccggaaagatggtggccgactcgatgaccggcgctcagacgccgaccgtcatgcgccacttcgatccgctgcgctga

SEQ ID NO: 522 - protein, 417 aa, Rhodococcus erythropolis DSMZ 44522
  DOMAIN (9)...(400): FAD dependent oxidoreductase
  SITE (119)...(122): N-glycosylation site. Prosite id = PS00001
  SITE (352)...(360): Myb DNA-binding domain repeat signature 1. Prosite id = PS00037
MGTRQSPDRVVVVGAGVVGLSTAWFLQERGVEVTVVDRDGVAADASWGNAGWLAPALTLPLPEPAVLQYGLRAMLSPSSPVYVPLTTDLKLIRFLVGFARHCTPSKWQEAMSVYTEVNRTALGAYDELADGGVKELTRLADPFLAAFASEKDRQTLVDEFHHVEAAGGEVDFDLLDYDAIHSLEPSLGQGVKAGLRLRNQRFIDPPLFVNSLADAVRERGGEIVSGFDVTQIDDRVGGVTVRSAHGDSRDGDAVVISSGARLNKLAAPFGVRKLVQAGRGYSFSVKPEHLPKNPVYFPTQRVACTPLHDRFRVAGMMEFRSPDAPLDPRRVQAIIDAAKPMLSGIDWTAREEEWVGSRPCTTDGLPLIGATRSPRVHVAGGHGMWGIALGPLTGKMVADSMTGAQTPTVMRHFDPLR

SEQ ID NO: 523 - DNA, 1245 bp, Unknown
  Obtained from environmental sample
atgaaaaaaaagatactcgtaatcggcggcggtgccatcgggcttttttgtgcgtattatctcaggaagtccggccacagtgtaacggttgttgataaaagcgatttgtcagataattgttcttatggaaatgcaggcttgattgttcccagccatgttattcccatggcttctcccggaatggtctcatcggcattcaggtacatgcttaaccccaaagcgcctgtggcctttaagtttccaccctcgctgagttttttactatggtcttcccggtttctcatgaaagccaatcatctgcatgcctggaggtctgctgcaattttgaaggaaatcagtcttcttagtaaagggctctaccataacctcatgaaaaatggtgaaatagccgtggggttggaggaaagcgggttgctggttgtatgccgttcgcctaaagtgaaaacggaagaagctgaggctgccgaaatagccaatgaggtcggagtagctgctcgtgtgctttcatcggaagaagtgttgaaaatggaaccgtcgctgatgcaggaaatagccggtggcgtttattatcctggcgatgggcgcctgaatccgccacaattaatgaggagtttgctttctcaccttgaagatcaaggcgtttttttcatgagaaatgctactgtaaagaaactggagaaaaaaggtaacgcatataagtacgcggtggtcaacggcgagcagatagagtttgacgagttggtcattgcagcgggagtgtggagcaatgatctattgaaattggttggcaacaaggtgctgctgcagccgggaagagggtatagttttgatgttgaaaacacctgttccatccgaaaacccgcgttgctgattgatgccagggtatccgttacgccctttgtggacggtaccgtgcggtttggtgggggcatggagctgggatattttggcaaaagtattttcaggaaaagggttagtgaaatatgcaaatctgctaatcaatactatcccggactcgggaaattggaaatcagtaatttgcagatatggcaaggccaccgcccttgctcctttgatggcctgccatatattggcagggtgccgaagcatgacaatgtatatcttgccaccggccattccatgatgggcatcacactcgcccctgctaccgggaaattggtgagtgaactgattggtgaagtagagccttcgatggatgtatctgctttcagggtggacaggtag

SEQ ID NO: 524 - protein, 414 aa, Unknown
  Obtained from environmental sample
  DOMAIN (4)...(397): FAD dependent oxidoreductase
  SITE (39)...(42): N-glycosylation site. Prosite id = PS00001
  SITE (222)...(225): N-glycosylation site. Prosite id = PS00001
MKKKILVIGGGAIGLFCAYYLRKSGHSVTVVDKSDLSDNCSYGNAGLIVPSHVIPMASPGMVSSAFRYMLNPKAPVAFKFPPSLSFLLWSSRFLMKANHLHAWRSAAILKEISLLSKGLYHNLMKNGEIAVGLEESGLLVVCRSPKVKTEEAEAAEIANEVGVAARVLSSEEVLKMEPSLMQEIAGGVYYPGDGRLNPPQLMRSLLSHLEDQGVFFMRNATVKKLEKKGNAYKYAVVNGEQIEFDELVIAAGVWSNDLLKLVGNKVLLQPGRGYSFDVENTCSIRKPALLIDARVSVTPFVDGTVRFGGGMELGYFGKSIFRKRVSEICKSANQYYPGLGKLEISNLQIWQGHRPCSFDGLPYIGRVPKHDNVYLATGHSMMGITLAPATGKLVSELIGEVEPSMDVSAFRVDR

SEQ ID NO: 525 - DNA, 1242 bp, Unknown
  Obtained from environmental sample
atgcgcgcggatgtgatcgtgctcggggcgggcatcgtgggggtgtcggtcgcggtccatctacagaggcgcgggcgggcggtgattctcgtcgataagcgcgaacccggggaaggcacctctttcggcaataccgggctcatccagcgcgaggcggtctacccctacagcttcccgcgcagctggcgcgagatttttcggcacagccgcaaccgtgcaatcgatacccattatgactggaaggcgctgccgcgccttgcgcccttcctcgcacgctattggtggcactcgagtacgcggcggcacgccgaaatcgcgagaaaatatgcgcccctgatcgagcgctgcgtgccggagcatgtggcgcttgccgaggaggcgcaggcgtcggcgctcctccggccggggggctggatcaaggtcttccgttcgccggcggcgctcgaagagcgggcgcgcgacgccgagctttgggcgcgcgagttcgggatcgagtacaaggtgctcgagccgagcgcgcttgcggcgatggagccgcatctcgatccgacactcgtcggtgcgctgcatttcccggaaccggtcggcgtgaaggatccgcatgccttgacaatggcttacgtgcggctgttcgagcggctcggcggctcgcgggcgaaaggcgacgccgcaagcctcgaacccgcgccgggcggctggcgggttgcgacggaccgcggcccggtcgaggccggcgaggtggtggttgcgctcggcgcgtggtcggacgtcgtgacgaatcgtctcggctatcacctgccgctcggagtgaagcggggctaccacatgcattatcggccggccggcaacgccgtcctcaaccacaccatcctcgatgccgagaccggctatgccatggcccccatgaaccgcggcatccggctcaccaccggcgccgagttcgccgacaaggattcactcaagacgcccgtccagctcgatcgtgccgagcccctcgcccggaagctgttcccgcttggcgagcggctcgaccccgagccgtggatgggggtcaggccctgcacgcccgacatgctgccggtgatcggcccggcgccccggcacaagggcctgtggttcgccttcggccatgcccatcacgggctcacgctcgggcccgtgaccggccggctcctcgcggagatgatgaccggaagcgcgcccttcatcgatccgacgccttacagagcggatcgcttctag

SEQ ID NO: 526 - protein, 413 aa, Unknown
  Obtained from environmental sample
  DOMAIN (4)...(395): FAD dependent oxidoreductase
  SITE (291)...(294): N-glycosylation site. Prosite id = PS00001
MRADVIVLGAGIVGVSVAVHLQRRGRAVILVDKREPGEGTSFGNTGLIQREAVYPYSFPRSWREIFRHSRNRAIDTHYDWKALPRLAPFLARYWWHSSTRRHAEIARKYAPLIERCVPEHVALAEEAQASALLRPGGWIKVFRSPAALEERARDAELWAREFGIEYKVLEPSALAAMEPHLDPTLVGALHFPEPVGVKDPHALTMAYVRLFERLGGSRAKGDAASLEPAPGGWRVATDRGPVEAGEVVVALGAWSDVVTNRLGYHLPLGVKRGYHMHYRPAGNAVLNHTILDAETGYAMAPMNRGIRLTTGAEFADKDSLKTPVQLDRAEPLARKLFPLGERLDPEPWMGVRPCTPDMLPVIGPAPRHKGLWFAFGHAHHGLTLGPVTGRLLAEMMTGSAPFIDPTPYRADRF

SEQ ID NO: 527 - DNA, 1248 bp, Unknown
  Obtained from environmental sample
atgacaaaggacgcaatcgttctcggtgccggcatcgtcggcgtttcgacggcaattcatctgcagcgacgggggcgtcaggtcacccttgtcgacaagagggagcccggccgggaaacatcctttggcaatgccgggttgatccagcgcgaaggggtggtgccctacggctttccgcagcaattcggcctgttgctgcgctatgccctcaacaatcgcgtcgacgtgcactatcacctgcgcgccctgccctcgcaaatcgcgtttctcgcccgctattggtggaactccaataccaagcgccatgagatgatctcgcgcgcctatgcgccactgattgcgcattcggtcagcgagcacaacgaccttatccaagcctcacacgccgaagagctgatccggaagaacggttgggtggaattgttccgctcgaacgaaaagcgggatgccgagtttgccgaggccgagcgcctcaaccgggaattcggcattggttatgacgccttgagcagctcggaaattgcagcggccgagccgcacctcaaggacagctttgcaggagcgctgcgctggcgcgatccgtggtcggtcatggatccgcatgggctgacgtcggcttatcgccgctatttcgagagcatcggtggccgcgtcacgacaggtgatgctctctctcttgggatgtccggcaaatcctggaaaatggtcgcggcggaaggatcgatcgaggcagaagatgtcgtcgtggcgcttgggccgtgggccgatctggtcacgaaacggttcggctatgccttcccgcttggcgtcaagcgcggctaccatatgcactacgctgccgaagggaatgccgtcctcaacaatccgatgctggatgccgaacgcggctatctgctggccccgatgagccgcggcattcgactgacaaccggggccgaattcgcgcgccgcgatgcgccgaaaacaccggtgcagctggatcgtgcggaagcgcttgctcgctcggccttcccgcttggcgagcggcttgacccggaaccatggatgggcgcgcgcccctgcacgcccgacatgatgccgatcatcggcaaggcgccgcgtcatgaggggctatggttcgctttcggccatgcgcatcatggcctcacactcggaccggtgacgggccgtgttctcgccgagcttatcaccggcgagacgcccttcatcgatatctcggcttattcgcccggccgcttcgcgccctga

SEQ ID NO: 528 - protein, 415 aa, Unknown
  Obtained from environmental sample
  DOMAIN (4)...(395): FAD dependent oxidoreductase
MTKDAIVLGAGIVGVSTAIHLQRRGRQVTLVDKREPGRETSFGNAGLIQREGVVPYGFPQQFGLLLRYALNNRVDVHYHLRALPSQIAFLARYWWNSNTKRHEMISRAYAPLIAHSVSEHNDLIQASHAEELIRKNGWVELFRSNEKRDAEFAEAERLNREFGIGYDALSSSEIAAAEPHLKDSFAGALRWRDPWSVMDPHGLTSAYRRYFESIGGRVTTGDALSLGMSGKSWKMVAAEGSIEAEDVVVALGPWADLVTKRFGYAFPLGVKRGYHMHYAAEGNAVLNNPMLDAERGYLLAPMSRGIRLTTGAEFARRDAPKTPVQLDRAEALARSAFPLGERLDPEPWMGARPCTPDMMPIIGKAPRHEGLWFAFGHAHHGLTLGPVTGRVLAELITGETPFIDISAYSPGRFAP

SEQ ID NO: 529 - DNA, 1245 bp, Unknown
  Obtained from environmental sample
gtgccgcgaagcgacgttcttgtgctgggcgccggtatggtcggcgcctccgttgccgtgcatctcgccaagcggggcatgtcggcgacgctgatcgaccggcgagcggcgggggaggagacctcgttcggcaatgcgggcctgatcgaagcgagccggatgctgccgatcggattcccgcgcaacgtgcgtgagcttctacggcatgcaagcgggctctcaccgctcagccattttcactggagcgcattgccaggactggctccctttctgtggcggtactgggcggcgtcgcggccggagcggctcgatgcatcggcccgcatcttgcgtccgatgctggcttcggcgccggaggagcacacggcgctagcggcggaagcggggtcttctcgcctgatccgtagggcgggactcctcaagctgtttcgcacggaggagggctttcaggaaaccgccgccgatcgcgcctttgccgatgagttcggcgttccctacgaggtgctggaccgtgacgctgcgctcgcgcgggagccgcatttgcggcccgtattccgccgcgccttgttctggccgcacaccgacaattgctccgacccgggcgctttgaccaaatcttatgtcgcgctgttcgagaaactgggcggcgtattcgtgcgcggcgacgcgcgaagcttgcacccatttgcgggcggctggcgcgtcgagaccgacgccggcccggtcgacggccagcaagccgtgatcgcgctcggcccgtggagcatggatgtcgccggcaagttcggcgtccgtgtgccgttcgccgtcaagcgcggctatcacgtgcatcatgcgcctgtcggcaacgcaacacttagcgggggcgtgctcgattacgaaggcgggtatctgcttctgccgatggagcgcggcatccgcatcacgactggaatcgaattcgctcgccgcgatgcgccgccgacaccggtgcagattacccgtgtattgccggcggcgtgcgaattattcccgctcggcgaggcgcttgacgacaagccatggatggggtcgcggccggcgaccccggattccttgcccgttatcggccgcgcgccgggggggcaaaagagcctatggcttgcgttcggccattcgcatctcggctttacgctcgggccgccgaccggccggctgctgacggaaatgatcctgggcgaaaagcccttcgtcgatccggcgccgtttcgcgccgagcggttctag

SEQ ID NO: 530 - protein, 414 aa, Unknown
  Obtained from environmental sample
  DOMAIN (5)...(396): FAD dependent oxidoreductase
  SITE (199)...(202): N-glycosylation site. Prosite id = PS00001
  SITE (287)...(290): N-glycosylation site. Prosite id = PS00001
MPRSDVLVLGAGMVGASVAVHLAKRGMSATLIDRRAAGEETSFGNAGLIEASRMLPIGFPRNVRELLRHASGLSPLSHFHWSALPGLAPFLWRYWAASRPERLDASARILRPMLASAPEEHTALAAEAGSSRLIRRAGLLKLFRTEEGFQETAADRAFADEFGVPYEVLDRDAALAREPHLRPVFRRALFWPHTDNCSDPGALTKSYVALFEKLGGVFVRGDARSLHPFAGGWRVETDAGPVDGQQAVIALGPWSMDVAGKFGVRVPFAVKRGYHVHHAPVGNATLSGGVLDYEGGYLLLPMERGIRITTGIEFARRDAPPTPVQITRVLPAACELFPLGEALDDKPWMGSRPATPDSLPVIGRAPGGQKSLWLAFGHSHLGFTLGPPTGRLLTEMILGEKPFVDPAPFRAERF

SEQ ID NO: 531 - DNA, 1257 bp, Unknown
  Obtained from environmental sample
ttgaaagtcgtcatcctgggggccggtattaccggcataagttcggcgtggtttctgcgcgaagcagggttcgatgtgacggtaatagaccgtcagcccgaggccgcactggaaaccagcttcgccaatggcgggcagatttctgtctcgcaatccgagccctgggctaatcccgatgcacccatgaaggtactgaagtggctgtggcgggacgattcccccctgctcttccgcccgcgtcttgataccaagcaatgggcctggggcatgcgcttcctgcgcgaatgcctgcccggccggagcgagcagaacattgtccagctggttaacctggggctctatagccgcagcacgctcaaggcgctgcgtgagagcaccggcatccagtacgaccatctgagccgcggcatcctgcagatcttctttgaccagcaaagcttcgatgccgctgccgaggcctcggcgctgatgcgccgttacaactgctaccgcgaggccattccgcgcgagcgggcggtggagctggagcccgcgctggccgtactgggcagccgcctgaccggagccatctgggctgaggacgatgaatcgggcgacgctcgcctgtttacccagcagctggccaccctggccgccgagcgcggggtggagttccgctacaacacctgcatacgctcgctggaagctgagggcggcaagatcaccggcgtgcgcgcctgtagcagcgacggtagcgccgctaccatacagggtgatgcctacctgatctgcctgggcagctacagcccacagctgttggcgcccttgggcgtctacctgccggtctaccccaccaagggttactcggccaccatggtgaccgagggcttcgagggcgcgcccaccgtcagcatcaccgacgacgccatgaagatggtctacacccggctgggtgaccgcatccgcattgccggcacggccgaactcgacggttacaacactgaactgaatgaggtccgctgcgaggcgctgatccggcgctacttctcgctcttccctaattcggccgaccccaattcggtgcagtattggaccggcctgcggccttccacgccgtccaacgtgcccatcattggccgctcgcggcttagcaacctctacttcaacaccggccacggtaccttgggctggaccgaggggccaggttcgggccgggccattgccgagatcattgccggccgcaaaccggagctggagtttggctttgtgggaacttga

SEQ ID NO: 532 - protein, 418 aa, Unknown
  Obtained from environmental sample
  DOMAIN (2)...(403): FAD dependent oxidoreductase
MKVVILGAGITGISSAWFLREAGFDVTVIDRQPEAALETSFANGGQISVSQSEPWANPDAPMKVLKWLWRDDSPLLFRPRLDTKQWAWGMRFLRECLPGRSEQNIVQLVNLGLYSRSTLKALRESTGIQYDHLSRGILQIFFDQQSFDAAAEASALMRRYNCYREAIPRERAVELEPALAVLGSRLTGAIWAEDDESGDARLFTQQLATLAAERGVEFRYNTCIRSLEAEGGKITGVRACSSDGSAATIQGDAYLICLGSYSPQLLAPLGVYLPVYPTKGYSATMVTEGFEGAPTVSITDDAMKMVYTRLGDRIRIAGTAELDGYNTELNEVRCEALIRRYFSLFPNSADPNSVQYWTGLRPSTPSNVPIIGRSRLSNLYFNTGHGTLGWTEGPGSGRAIAEIIAGRKPELEFGFVGT

SEQ ID NO: 533 - DNA, 1269 bp, Unknown
  Obtained from environmental sample
atgagaaattccaaatcggtcgtcgtctgcggcggtggcatcgtgggcctgtgcaccgcctattacctcgcgcgcgagggctgcacggtgaccatcgtcgagcggcaggccggacccgcgcacaaccactgcgccaccggcagctcgggctacgtgtcgccgagccacgtcatcccgctcgcggctccgggcatggtctggaaggggctcaagtggatgttcaattcgcgcagcccgttctacatccagccgcggctcgacaccgagctgatgcgctggggctggctgttctggcgcgcgagccgccgccggcgggtggagcgggccgcgccggtgctgcgcgacctgtgcctgctgggacgccagctgttcgaggaactcgacgacctcaccgcggggcggtccgagttccgcaaggacggcctgctcaacctctgccgcacgccgcagggcctcgaccacgaggcgcacggcctggcccgcctcgccaacgagctgggcgtcgaggcgcgggtgctcgatgccgcccagaccgcggccctcgggctcggcgtgaagctggacatcgccggctcggtttattttcccatcgacgcgcacctcacgcctgcccgcttctgcgcggcgctcacggacctgctggaggagatgggcgtgcgcttccaatggagcacgacgatctacggctggcgctcggcggagaaccgcatcgccgcggcccacacgaccgcaggcgacctggtcgcggacgagttcgtcctcaccggcggctcctggtcggcgggcatgctggccggcctcggcctgcgcctgccgatgcaggcgggcaagggctacagcctcacgctgcccgcgccacgcttccacgtcacgaagcccttcatcctcaccgagcggcgcattgccgtgacgccgatgggcagcacgctgcgcttcggcggcacgatggaaatcgccgggcacaacgaccgcgtccgccccgagcgcgtggagcagatcaaggccggggtcatggccttcctgccggagttcaccgcggacgatttcgccggcatcaaaccgtggttcggctaccggccggtgacgcccgacggcctgccgtacatcgggcgcgtcggccgcgtgcgcaacctcacggccgcctgcgggcacgcgatgcttggcgtgacgctcgcgccgtcgaccgggcgcctggtcgcggaggtgatcgcgggtaagaagccgtcggtcgatctgacactgcttgatcccgatcgctacgcccgctga

SEQ ID NO: 534 - protein, 422 aa, Unknown
  Obtained from environmental sample
  SIGNAL (1)...(24)
  DOMAIN (6)...(402): FAD dependent oxidoreductase
  SITE (382)...(385): N-glycosylation site. Prosite id = PS00001
MRNSKSVVVCGGGIVGLCTAYYLAREGCTVTIVERQAGPAHNHCATGSSGYVSPSHVIPLAAPGMVWKGLKWMFNSRSPFYIQPRLDTELMRWGWLFWRASRRRRVERAAPVLRDLCLLGRQLFEELDDLTAGRSEFRKDGLLNLCRTPQGLDHEAHGLARLANELGVEARVLDAAQTAALGLGVKLDIAGSVYFPIDAHLTPARFCAALTDLLEEMGVRFQWSTTIYGWRSAENRIAAAHTTAGDLVADEFVLTGGSWSAGMLAGLGLRLPMQAGKGYSLTLPAPRFHVTKPFILTERRIAVTPMGSTLRFGGTMEIAGHNDRVRPERVEQIKAGVMAFLPEFTADDFAGIKPWFGYRPVTPDGLPYIGRVGRVRNLTAACGHAMLGVTLAPSTGRLVAEVIAGKKPSVDLTLLDPDRYAR

SEQ ID NO: 535 - DNA, 1581 bp, Unknown
  Obtained from environmental sample
atggaactgaaaggtctgtccctgatcggctttggcgaaggtgcgaagggcggtgcgccgctcaccgccagcaatgcgaccaccggcgagaagctcgccccggtcttccagtcggcctcggccgccgaggtggagcgcgccgcgcagctcgcggccgcggcgtttcccgtctttgccgccacgtccggcaaggttcgcgccggttttctccgcctggcggcgcagaaactcgaggccgccacggccgagctcgccgcccggggcaacatcgagacggccctgccgctggcgcgctgccagtcggaggtcggccgcaccatcggccagctgcgcctgttcgccacggtggcggagaagggcgactgggtggacgcgcgcatcgaaaccgcccagccggatcgcaagccggttccgaagcccgaccaccgttcgctctacgagccgctcggcccggtcgtcgtcttcggcgccagcaactttccctatgccttttccgtggccggcggcgacactgcctcggcgctcgccatcggctgcccggtgatcgtgaaggcgcactccggccacctcgggacctccgagctggtggggcgcctgctgggcgaggccgtgcgcgagtcgggcctgcccgagggcacgttctcgctgatcttcggttccggcgtcgagaccggccaggcgctggtgaagcacgccgcggtccaggccgtgggcttcaccggttcgcgcaaggcgggcgtcaacctgatgcaggtcgcggccgcgcggccgcagccgattccggtctatgccgagatgagcagcgtcaacccgctgttcgtcaccccggccgcgatcaaggcgcgttccgcggcgctggtcgacgggctcgcggcgtcgatcacgctcggcgtcgggcagttttgcacgaacccgggcctgctcatcgtgcaggcgggcgcggaaaccggcgcgttcctcgcggcgctcggcgccaagctggcggcgacgccgccggcctacatgctgaccaagggcatttgcaaagcctacgggcacggcatcgacgaacgcacgaaggccgcgggcgtgacaatcctgtcgcgggcgccggccggcgccgacggcacggccgccgcggtgctgttctccacgacggcggaaaatttcctgaagtcgccgggcctcgccgaggaaatcttcggccccagcacgctcgtcatcctgtgccgcgaccgcgcggaggtgctggcggtggccgcggtgggcgagggccagctgaccgcgaccatccacgcggagacgggcgaggatgtcgccgacctcgtgcggctgctcgcggtccgggcgggccgcgtgatcatgaacggttacccgacgggcgtggaagtcagccacgccatggtgcacggcgggccgttcccggcgaccgccgacggccgcagcacgtcggtcggcacgcgggcgctttaccgcttcgtgcgcgcggtgtgctaccagaatttcgccgacgccgccctgccgccgtcgctgcagaacgccaatcccctcggcctgcaccggctcgtcaacggcgagctgacgcaggacgcggtcaggtag

SEQ ID NO: 536 - protein, 526 aa, Unknown
  Obtained from environmental sample
  DOMAIN (11)...(490): Aldehyde dehydrogenase family
  SITE (25)...(28): N-glycosylation site. Prosite id = PS00001
MELKGLSLIGFGEGAKGGAPLTASNATTGEKLAPVFQSASAAEVERAAQLAAAAFPVFAATSGKVRAGFLRLAAQKLEAATAELAARGNIETALPLARCQSEVGRTIGQLRLFATVAEKGDWVDARIETAQPDRKPVPKPDHRSLYEPLGPVVVFGASNFPYAFSVAGGDTASALAIGCPVIVKAHSGHLGTSELVGRLLGEAVRESGLPEGTFSLIFGSGVETGQALVKHAAVQAVGFTGSRKAGVNLMQVAAARPQPIPVYAEMSSVNPLFVTPAAIKARSAALVDGLAASITLGVGQFCTNPGLLIVQAGAETGAFLAALGAKLAATPPAYMLTKGICKAYGHGIDERTKAAGVTILSRAPAGADGTAAAVLFSTTAENFLKSPGLAEEIFGPSTLVILCRDRAEVLAVAAVGEGQLTATIHAETGEDVADLVRLLAVRAGRVIMNGYPTGVEVSHAMVHGGPFPATADGRSTSVGTRALYRFVRAVCYQNFADAALPPSLQNANPLGLHRLVNGELTQDAVR

SEQ ID NO: 537 - DNA, 1260 bp, Unknown
  Obtained from environmental sample
atgaagccggacgtgattgtactcggtgccggaatggtcggcgtctcgacggctctccatctccagagccacggccatgacgtggttctggtcgaccgtcgtcctcccggcgaggaaacctcgtacggcaatgccggcgtcatccagcgcgaggccgtggaaccctatgcctttccccggtccgcgctgcagctcctgcgcttcgcgtgcaagaccggcccggaggtgaactatcattttcgcgccctgcccggactggtggggccgcttctgcggtactggtggtattccgcgcccgcccgctaccctgccatcgccgccgcgcatgcaaggctgatagagcaatgcctcagcgagcacgaggtgctgatcgggcaggccgcggcggacgacctggtgcggcgcgacggtttccgctttgtctatagatcggccaaggccctggagaccgacgcggcgcaagcccggcaactggcagaagaccatggccttgcctgcgatcttcttgacggcgatgccctggcgcgggccgagccggcgctgaaacggccgttggccggcgcgcttcactggcgcgatccctggacggtctgctcgccgggagagcttgtcgtccgctatgcggcgctgttccagcggaggggcgggaccgtgctgaccggcgatgcggcgagcctggcccggcagggaaataccggctgggcggtgatgacggaggacggcaagctggaggccgccaatgcggtgatcgcgcttggcccctggtcggtggagaccgcaaggcgcctcggataccgcctgcccctgttcgtcaaacgcggctatcatcgtcattaccggccccccgatggcgccgcgcggctggcactgccgacgctggatgcgcagaagggggtcgtgctggcgcccatggtacaggggctgcggatcaccaccggcgccgagttcgcccggctcgaagcgccatcgacgccggtgcagatcgacggtgccgcccgggcggcggccgagttgctggatatcggcgcaccggtcgagccggcaccgtggtgtggcgcgcggccctgcaccccggacatgctgccggtggtcggtgccgcgccgcgccacaacggcctgtggttccatttcggtcatgcccatcagggcttcacgctcggccccgtcaccggcaggctcattgcggagatgatcgggggcgaacgccccttcctcgacccgtcaccttatgccgtcacccgctttgccggcgggcgctga

SEQ ID NO: 538 - protein, 419 aa, Unknown
  Obtained from environmental sample
  DOMAIN (4)...(397): FAD dependent oxidoreductase
MKPDVIVLGAGMVGVSTALHLQSHGHDVVLVDRRPPGEETSYGNAGVIQREAVEPYAFPRSALQLLRFACKTGPEVNYHFRALPGLVGPLLRYWWYSAPARYPAIAAAHARLIEQCLSEHEVLIGQAAADDLVRRDGFRFVYRSAKALETDAAQARQLAEDHGLACDLLDGDALARAEPALKRPLAGALHWRDPWTVCSPGELVVRYAALFQRRGGTVLTGDAASLARQGNTGWAVMTEDGKLEAANAVIALGPWSVETARRLGYRLPLFVKRGYHRHYRPPDGAARLALPTLDAQKGVVLAPMVQGLRITTGAEFARLEAPSTPVQIDGAARAAAELLDIGAPVEPAPWCGARPCTPDMLPVVGAAPRHNGLWFHFGHAHQGFTLGPVTGRLIAEMIGGERPFLDPSPYAVTRFAGGR

SEQ ID NO: 539 - DNA, 1242 bp, Unknown
  Obtained from environmental sample
atggacttcgacgtaatcgttctgggcgcgggcatcgtcggcgtgtccgccgcgctgcacctgcaggatcgcggccgcaaggtcgccctcgtcgaccgcggtgcgcccggcgaaggcacgagcttcggcaacgcggggctgatcgagcgctcgtcggtcgaaccgtatccgttcccgcgcagcccgttcacgctgatgcgctacgcgctgaaccgctcgaccgatctctactggcacagcacgtcgctgccggcattcgcgccgtggctcgcgcgcttctggtgggaatcggcaccgatgcgtcatgcggcggcctcccgcgacatgctgccgctgatcgagcgctgcatcgtcgagcacgacgcgctgatcgcgcgcgccggcgccgcggagctgatccgtgcgagcggctggatggaagcgttccgcacgccggccgcgttcgaacgcgcggtcgccgatgccgggctcaccgcgcgccgccacgggctcggcatcacgccgctcgacgccgcggcgctgcgggcgcaggaaccgagcctcgcgccgggtttctgcggcgcgctgcactggctcgatccgaagagcgtcgtcgatccgtccgcgctcgtcaaaacctacgcgcacctcttcgtgcaaggcggcggcacgctgctcaacggcgacgccgcgagcctcgaagcgctctcgccgggctggcaggtcacgacgagcgacggcaggatcgccgcgccggccgtggtcgtcgcgctcggcccgtggtccgacacggtgttcggcaagttcggctacaagattccgctgcgcgagaaacgcggctatcacatgcactacgcgccatccgaacgcggcacgccgtcggcaccgatcgtcgatcgcgaatacggctacgtgatcgcgccgatgcggcgcggcctgcggctgacgaccggcgtggaaatcgcgcgccgcggcctgccgccgacgggcgtgcagctcgaacgtgcggaacgcgtcgcgcgcccggtgttcggcttcggcgaacggctcgacccgcagccgtggctcggcttccgcccatgcacgcccgacatgcggccggtgatcggccccgcgcccgcgcatcgcgggctgtggttcgccttcgggcacaaccatcacgggctgacgctcggccccgtgtccggtcggctgctcgccgagatgatgacgggcgacaccccgttcaccgatccgacgccttatcgcgcggatcgtttctga

SEQ ID NO: 540 - protein, 413 aa, Unknown
  Obtained from environmental sample
  DOMAIN (4)...(395): FAD dependent oxidoreductase
  SITE (72)...(75): N-glycosylation site. Prosite id = PS00001
MDFDVIVLGAGIVGVSAALHLQDRGRKVALVDRGAPGEGTSFGNAGLIERSSVEPYPFPRSPFTLMRYALNRSTDLYWHSTSLPAFAPWLARFWWESAPMRHAAASRDMLPLIERCIVEHDALIARAGAAELIRASGWMEAFRTPAAFERAVADAGLTARRHGLGITPLDAAALRAQEPSLAPGFCGALHWLDPKSVVDPSALVKTYAHLFVQGGGTLLNGDAASLEALSPGWQVTTSDGRIAAPAVVVALGPWSDTVFGKFGYKIPLREKRGYHMHYAPSERGTPSAPIVDREYGYVIAPMRRGLRLTTGVEIARRGLPPTGVQLERAERVARPVFGFGERLDPQPWLGFRPCTPDMRPVIGPAPAHRGLWFAFGHNHHGLTLGPVSGRLLAEMMTGDTPFTDPTPYRADRF

SEQ ID NO: 541 - DNA, 1266 bp, Unknown
  Obtained from environmental sample
atgcaacacgagatgcgcgtgaacgatgtcatggtttttggtgccggcgtatccggtctggcgaccgcgatcgcgttgcagaacgatggtcgtgacgtctgcgtcatcgatgccggccgcatcggcgctggtgcttcccacggcaactgcgggacgctgacgcccagccacgcgccgccactggcggcacccggcacgatctcccgggcgctgcgctggatgctgacgcccgacgcgccgctgtacatcccgccgcgtttcgatcccgcgctgtggcgctggctgctcggtttcgcgatgcgctgcaaccagcgcgactggatcgccagcgcgcgcgcgaagtcggcgctgctcaacgattcgcgccagcgcatcgccgactgggtgcgcgaccatgacttgcaatgcgaattcgccgaagacggggaggattacgtgttccgcgatccgcgcgcgctggaacacgagttgcgcgaacttccgttgctgcgcgagctcggcgtcgaagcggacgtcatcgacggcgccgcgtacgaagcgcaggaaccaacgctgaaaccgggcgtggcgggcgcgatccgcttcgccggcgatgccgcgttgcggccggaccgttacgtcgcggaactggcgcgcgtggtgcgcgggcgtggcggccgcatcgtcgaacactgcgcgctgcaatcgctccgcgtcgatgcgaatggcgtggaagcgacgacctcgcaaggcgtaatgcgcgcgcgcgatgcggtggtcgcctgcggtgcatggtcgccgacgctcgcccgcgccatcggcctgccctggctgcgcaaggcgatccagccgggcaagggctattcgatgacctacgacgcgcccgtgctggtgccgaaacgcccgctggtgctgcgcgaggtgtcggtatgcgtcaccgcgtggggcagcggcttccgcctcggcagcacgatggaattctccggctacgacgccacgctcaacgagcgccgcctcggcgcgctggaacgcggcgcgcgcgaatacctgcaccatccggtcggccccggattgcgcgagcgctggtgcggctggcggccaatgagccgcgacgacatcccgttgatcggccgtgcaccgggccatcgccatctctggctggcgactggccacggcatgatgggcgtgggcatgagcgccggcaccgggcagctgctcgccgacctggtcgcgggccgcgcgcccgcgatcgatccggcgccgttcgatcccgcgcgattcgcatga

SEQ ID NO: 542 - protein, 421 aa, Unknown
  Obtained from environmental sample
  DOMAIN (9)...(402): FAD dependent oxidoreductase
  SITE (120)...(123): N-glycosylation site. Prosite id = PS00001
MQHEMRVNDVMVFGAGVSGLATAIALQNDGRDVCVIDAGRIGAGASHGNCGTLTPSHAPPLAAPGTISRALRWMLTPDAPLYIPPRFDPALWRWLLGFAMRCNQRDWIASARAKSALLNDSRQRIADWVRDHDLQCEFAEDGEDYVFRDPRALEHELRELPLLRELGVEADVIDGAAYEAQEPTLKPGVAGAIRFAGDAALRPDRYVAELARVVRGRGGRIVEHCALQSLRVDANGVEATTSQGVMRARDAVVACGAWSPTLARAIGLPWLRKAIQPGKGYSMTYDAPVLVPKRPLVLREVSVCVTAWGSGFRLGSTMEFSGYDATLNERRLGALERGAREYLHHPVGPGLRERWCGWRPMSRDDIPLIGRAPGHRHLWLATGHGMMGVGMSAGTGQLLADLVAGRAPAIDPAPFDPARFA

SEQ ID NO: 543 - DNA, 1248 bp, Unknown
  Obtained from environmental sample
atgtcagatatattaataataggcgctggaatagtcgggcttagctctgcctactatttgcgaaagcagggacatcatgtagttgtccttgataagagtgatattgaggataactgttcatttggaaatgccggaatgattgtcccaagtcattttgtgccgcttgccgctcctggtatggttcagcagggcatcaggtggatgttcaatagtaaaagcccgttttatgttaagccttctttaaacaaaaatcttgttagctggggcttaaaatttattaaacatgccaatgatagccatgttgccagtgctgcggagcccttaagagatctttcgcttttgagcaaaagattgtaccaggatctggctaaggagcccggctttgactttggtcttgttaataacggaatcctggctttttataaaacggagaaggcggcggaagaggaagcgcatctcgccagcagaggaagagcgctgggcttagatatggtagttttaagcccggctgaatgtaaaactttgcagcccgggattgaacttgatgtgctgggagccgttcattataagtgtgattcccacctttatcctgcaaaattaatgcgggcactgatcagctttttagaaaataatggtgtcaagattgtacggaaccacgaagttaccgcgatagattctaagaatgggaaaattgattccgtaagaactggaggaaaagtatggaaggcagaccaatatatattggcaacaggatcatactctccggcgttggccaaactggtaaatgttaagttatccattatgccgggaaaaggatattcttttatggaagaaaataaggacaacaaacttactatccctgcgctgctatgtgaggctagagtggccataacgcctatgaatggtgaaatccgttatggcgggactatggagcttgcgaagattaacagtcacataaatatgaaaagagtgcagggcatagtagagtctgttccaaaatatatgaccaatttaactcccgctgtacctcaagccgacaaaatatggtatggattcagacctgcctctcccgatggtttaccttatatagggagaagtaaggagttagataatttattgatcgctactggccacgggatgatgggtttaggccttggtcccgctaccggattattggtgagccagctcgttgatggagccaaaactgaaatcgatataaaaccattttcaccgtcaagatttgattaa

SEQ ID NO: 544 - protein, 415 aa, Unknown
  Obtained from environmental sample
  DOMAIN (3)...(396): FAD dependent oxidoreductase
  SITE (38)...(41): N-glycosylation site. Prosite id = PS00001
  SITE (98)...(101): N-glycosylation site. Prosite id = PS00001
MSDILIIGAGIVGLSSAYYLRKQGHHVVVLDKSDIEDNCSFGNAGMIVPSHFVPLAAPGMVQQGIRWMFNSKSPFYVKPSLNKNLVSWGLKFIKHANDSHVASAAEPLRDLSLLSKRLYQDLAKEPGFDFGLVNNGILAFYKTEKAAEEEAHLASRGRALGLDMVVLSPAECKTLQPGIELDVLGAVHYKCDSHLYPAKLMRALISFLENNGVKIVRNHEVTAIDSKNGKIDSVRTGGKVWKADQYILATGSYSPALAKLVNVKLSIMPGKGYSFMEENKDNKLTIPALLCEARVAITPMNGEIRYGGTMELAKINSHINMKRVQGIVESVPKYMTNLTPAVPQADKIWYGFRPASPDGLPYIGRSKELDNLLIATGHGMMGLGLGPATGLLVSQLVDGAKTEIDIKPFSPSRFD

SEQ ID NO: 545 - DNA, 1296 bp, Unknown
  Obtained from environmental sample
atggcgcagaaggcaagcgcaaggatcgaaccccatggaagaagctcaatggcccgctgcgacgtgatcgtgctcggcgccggcattgtcggcgtctcaactgccctgcatctggcgcgccgcggcgtcgctgtggcgctggtcgaccgcgacaagccgggcgagggcacctcctacggcaatgccggggtgattggcggtgcgggcgtctatccaacggctttcccacgtgatttcggtacactgctgaaggtggcgctaaaactctcgccggccgccaattatcacctcgccgatttgccgcggctggcgccctggctgttcgcctatttccgcgcctcctcgccgcgcgaactcgaagccacggcccgcgcgctgcggccgctgatggcggtggcggttgccgagcacgagatactgatggccgagtcggatgcgctgggtttcctgcgcaaggacggctggatctcgatctatcgcagcgccggcggctttgccgacatggccccgcagctggcgctcggcgaggaacttggcgtgcgcgccgtaacgctcgatcccgacggcgcacaggcgctggagccgagcctttcgccggtgttccacaaggcgatccactggcccgacatcgccagcgtctccgatcctcttggcgtgaccgaggcctataccgcgcgcttccaggcgctcggcggtctcgtgctcaccggcgatgcccgcagcctgcaccgcagcggcgaaaactggcgcgtcgacaccgcggaaggaccggtcgatgcgccgcaggcggtgatcgcgctcggcccctggggcgccgatctgctcgaaccgctcggcgtgcagctgccgctcgcggtcaagcgcggttatcaccggcatttccgcggcgagggcaatgccgcgctcaagcggccaatcgtcgacccggaggtcggctatgcgctggcgccgatgcgccagggattgcggctcaccaccggcgctgagttcgcccgccgtgacgcgccgccgacgccggtgcagttcgaccggctgctgccggaggcgcgacggctgtttccgcttggcgagaccgccgatgcccgcacctggctcggcgcgcggccctgcctgcccgatatgcgcccggcgatcggcccggcgccgggccagcgcgggctgtggctcaatttcgcgcataaccatttcggcctgacgctcggccccgtctccggtcgcctgcttgccgatatgatgttcgacgacaccccgctctgcgatccggcacctttctcaccggcgcggtttggcacctga

SEQ ID NO: 546 - protein, 431 aa, Unknown
  Obtained from environmental sample
  DOMAIN (21)...(411): FAD dependent oxidoreductase
MAQKASARIEPHGRSSMARCDVIVLGAGIVGVSTALHLARRGVAVALVDRDKPGEGTSYGNAGVIGGAGVYPTAFPRDFGTLLKVALKLSPAANYHLADLPRLAPWLFAYFRASSPRELEATARALRPLMAVAVAEHEILMAESDALGFLRKDGWISIYRSAGGFADMAPQLALGEELGVRAVTLDPDGAQALEPSLSPVFHKAIHWPDIASVSDPLGVTEAYTARFQALGGLVLTGDARSLHRSGENWRVDTAEGPVDAPQAVIALGPWGADLLEPLGVQLPLAVKRGYHRHFRGEGNAALKRPIVDPEVGYALAPMRQGLRLTTGAEFARRDAPPTPVQFDRLLPEARRLFPLGETADARTWLGARPCLPDMRPAIGPAPGQRGLWLNFAHNHFGLTLGPVSGRLLADMMFDDTPLCDPAPFSPARFGT

SEQ ID NO: 547 - DNA, 1266 bp, Unknown
  Obtained from environmental sample
atgaccgacaaacgacgcgttgttgtctgcggcggcggtgtgatcgggctgtgctgcgccgacagcctcgcgcgcgaaggtcacgaggtgacggtgatcgaccgcggcgccgagggggccgacacgtgtgcgcacggcagcgcgggctacgtgtcgccgagtcacgtggtgccgctcgccgcgccgggtatggtggcgctcgggctcaagtggatgctcgatccgcgcgggccgtttcatgtgaggccacggttcgatgcgggctttctgcgctgggcgtggttgtttgcgcgctcgtgcagcgaagcgaacgtcgcgcgcggcgcgccggtgttgcgcgatctctgtctcgcgagccgagcgatgttcgcggagttcgcgcgagagtcgggcaacgtgttcgagtatgccgagcgcggactgctgatcctctgccgcacacaggagacgctcgatcacgagacacacggcctcgcgcggatcgccaacgaactcggagtcgaggcgcgcgtgctcgacgcgtccgccacggcgcgcaccgagcccggcgtgcggatgagtgtcgcaggatcgctgcaattccccatcgatgcgcacgtgacgccgcggctcttcatgccggcgctgctctcgcggctgaaggctcgaggtgtggcgttccgctggggcacggagatcaccggttgggtcgagggcgaagggcgcacgatccgagcggtgcgcacgagcggcggcgacgtcgcgggagacgagttcgtggtcgcgggcggcgcgtggtcgccgctgctgttgcgcgggctcggcgtgaggctgccgatggaggcgggcaagggctacagtctcacgattcccgagtcacccgtgcccgtatcggtgccgatgatcctcgcagaggcacgcgtggcggtgactccgatgggtcgcgcgttgcgcttcggcggcacgatggaattgaccggcatcaacaacacgatccggccggagcgcgtcgaccagatcaaggccgctgcgtgccagttctatccggattttcctgccgccgcgttcgacggcctcgagccgtggtcggggctgcgtccggtgtcgcccgatgggctgccctacatcgggcgattcgcgtcgaggcccaacctgattgcggcgggtggccacgcgatgctcgggctcacgctcgcgccagtgacgggcgcgctcgtggccgacgtggtcgcaagccgcacgccctcgatcgcgctcgagcatctgagcccggatcgattcggatga

SEQ ID NO: 548 - protein, 421 aa, Unknown
  Obtained from environmental sample
  SIGNAL (1)...(24)
  DOMAIN (6)...(402): FAD dependent oxidoreductase
  SITE (326)...(329): N-glycosylation site. Prosite id = PS00001
MTDKRRVVVCGGGVIGLCCADSLAREGHEVTVIDRGAEGADTCAHGSAGYVSPSHVVPLAAPGMVALGLKWMLDPRGPFHVRPRFDAGFLRWAWLFARSCSEANVARGAPVLRDLCLASRAMFAEFARESGNVFEYAERGLLILCRTQETLDHETHGLARIANELGVEARVLDASATARTEPGVRMSVAGSLQFPIDAHVTPRLFMPALLSRLKARGVAFRWGTEITGWVEGEGRTIRAVRTSGGDVAGDEFVVAGGAWSPLLLRGLGVRLPMEAGKGYSLTIPESPVPVSVPMILAEARVAVTPMGRALRFGGTMELTGINNTIRPERVDQIKAAACQFYPDFPAAAFDGLEPWSGLRPVSPDGLPYIGRFASRPNLIAAGGHAMLGLTLAPVTGALVADVVASRTPSIALEHLSPDRFG

SEQ ID NO: 549 - DNA, 1254 bp, Unknown
  Obtained from environmental sample
atgaaggtgatcgtcttgggtgccggcgtaatcggcatcagcagtgcgtggtatctcgcgaaacaggggcatgacgtcaccgtggtcgaccgtcagcctggcgctggactcgaaaccagcttcgccaatggcgcgcagatttcggtctcccaatctgagccgtgggcgtcgccgggcgcgccattcaaagtgatgaagtggctgatgcaggacgacgcgccactgctgtttcgtccaaaacttgaatggcatcagctgtcttggggcatgcgctttctggtcgagtgtctaccgtggcgcttccgtcgcaacatccgcgaaatggtgaatctcggcctgtacagccgccaggcactgcaggagttacgcgcagagaccggcatttcctacgaccagatcacgcgcgggattctgcagttctacaccgacaagggcgatttcctggcagcacaagaggcgtcgaaattgctaagccagtacggcatcgatcgcgcggtaaaaacagccgacgaggcgattgcaatcgagcctgcgcttaaccatatccgtgatcgcctcgctggtgcgacttacgcagaaaccgacgaatccggtgacgcgcataccttcacgcaaaacctcgctggactgtgcgcgctcaaaggtgtgagcttcgcctacggcgcgatggttgaggcgattgagaccgacactggacgcgtcagcggcgtacgcgttcgtcactccactggccacaccgaaacactgaccgccgatgcatacgtgtgcgcaatgggcagctacagctatctgatgatgaagccgatcggcatcaccttgccggtctacccggcgaagggctactcggcgaccatatccaccaagggttttgagggcgcacccaccgtcagcctcaccgatgaggcaatgaagatcgtcttttcgcgtctgggtgatcgcatgcgcatcgcgggaaccgccgagctcgatggctacagcaccaacctctcgatcatccgcaccgaagcactggtgcgccgcgcgcgcgagttgtttccgaacgcagccgattacgatcatccggtgtactggaccgggctgcgtcctgcgacgccgtcgaactgcccgctgattggcaagaccaagtaccccaacctgttcttgaatacgggccacggcacgcttggctggaccgaggggccgggctccggtcgtgcgctcgccgacatcgtttccggcaagacgccggaagtcgattaccagttcctgaaatag

SEQ ID NO: 550 - protein, 417 aa, Unknown
  Obtained from environmental sample
  DOMAIN (2)...(403): FAD dependent oxidoreductase
  SITE (333)...(336): N-glycosylation site. Prosite id = PS00001
MKVIVLGAGVIGISSAWYLAKQGHDVTVVDRQPGAGLETSFANGAQISVSQSEPWASPGAPFKVMKWLMQDDAPLLFRPKLEWHQLSWGMRFLVECLPWRFRRNIREMVNLGLYSRQALQELRAETGISYDQITRGILQFYTDKGDFLAAQEASKLLSQYGIDRAVKTADEAIAIEPALNHIRDRLAGATYAETDESGDAHTFTQNLAGLCALKGVSFAYGAMVEAIETDTGRVSGVRVRHSTGHTETLTADAYVCAMGSYSYLMMKPIGITLPVYPAKGYSATISTKGFEGAPTVSLTDEAMKIVFSRLGDRMRIAGTAELDGYSTNLSIIRTEALVRRARELFPNAADYDHPVYWTGLRPATPSNCPLIGKTKYPNLFLNTGHGTLGWTEGPGSGRALADIVSGKTPEVDYQFLK

SEQ ID NO: 551 - DNA, 3306 bp, Unknown
  Obtained from environmental sample
aaagaattcggcacgagagacgcagaacgcctcggcaaattggtcagcgaccctgccggcctcgcgttggccgtcggttttgtcgacgatgtcgcccgcccgcaagacactgccgtggccgccaaggcgctcgccaaactcggcacgaaggccggtgacgcatccttcctgtcgcctgcagaccgcgcactgttccgtctcggcgccttcgccgctcccatcctgcctgccgtagttgtgcctgccgcgcggatgcgcctcaagcagcttgtcggccacctcgttgctgacgcgggtgatggcctgggtaaacacctggcgcgcacccgcgaggaaggttacgcgctgaacgtcaacctgctcggcgaggccgtgcttggtgccgatgaggctgccgcccgcctgcagcgcaccatcgacctggtcaagcgccccgacgttgactacgtgtccatcaaggtgtcgtctgtcgccgcacaactcgtcacctgggatcttgagggctcaaagcagcgtgtcgtcgacgagttgctgccgctgtaccgtgccgcacgggatcacggggtgttcctcaacctcgacatggaggagtaccgggatctcgcgctgacctgtgccgtcttcaccgatattctcgctcgcgacgagttcaagactctggaggcgggcattgtcctgcaggcatacctgcccgacgctgtcggcgcactcgacgacctgaccgaatttgcgcaggcccgcgtcgatgctggtggtgcgcgcatcaagattcgtctcgtcaagggtgcgaacctcgcgatggagtccgtcgaggctgaactgcacgactggaacctcgccacctacccgaacaagcccgatgtagacgccaactacctgcgcttcctcgaccgtgcactcgaccccgcccgcacccgcgcggtgcgcctcggcgtcgcctcacacaacctcttccacgtcgcgctcgccgtgctcgtcgcccgtacgcgcggcgtcggcgaggcgatggatatcgaaatgctccagggcatggctcccgcgcaggctgccgccgttcgcgccgaagtcgccctagacggcgggcgtgtcgtcctgtacacccccgccgtgcgtgacgaagacttcgacgtggccatcagctacctggtgcgtcgcctcgaagaaaacgccgcctcgcagaacttcctccacgcccagttcgctggcggccagggcgccatcgcaggccaggaggccgctttccgtaccgccgtcgctgctgccgttccgttcgcgccagaggccatcgccccgcgccgcaccccgcgctcgcagtggccgaatattgccgacgagatcgccgccgatggggtgttccgcaactccatcgacaccgaccctgccgtagctgcgcaccgaaacggcgccgccatcattatcgaccgtgaacagtccgggtacaagcctgttcagacgctgatgacgacggacgctgagactatcgacgctgcgctcacccgatccgtcgccgttcagcaggtatgggcagccgtgcccgctgccgcccgcgccgaggcgcttcacgccatcggacgtcgtttggaggccgcccggttcgacctcgtcgctgccgaagttcacgaggctggcaagacggtcgcagaagcagacccggaggtgacggaggccatcgacttcgcccactactacgctggctccgcgctcaccctcgacggggtgacaggcgcgaacttcacacccgacggagtcacgctcgttaccccgccgtggaacttccccgtcgccattcctgcaggcggtgtgcttgcggcgctcgcggccgggtcatccgttatcgcgaaaccggcttcgccgaccccgcgctgtttcgaacttgtcattgaggccgttcacgctggtcttgacgatgcgtcggcgacgaccggcttaacccctgagcagaaccgcgacatcgtccagtttattcgcgtctccgagcggtcgcttggtaagcagttggtcacccatgatgcggtggcccgcgtcatcctcaccggctccatcgagacagcggaacttttcgcgtcgtggaagcccgagcgtcccgtgcttgcggaaacctccgggaaaaactccatcattgtcaccgcgtcctccgacatcgacctggccgtcgctgacgtgctgcggtccgccttcggacatgccgggcagaagtgctccgctgcttcgttggcgattctcgtcggctccgtcggcgacccgaagtctgcgacgggcgaacgcttccgccgtcaactcatcgacgccgtgaagtccctggccgttggcgcaccgaccacgctgtccactgtcatgggtccgctgaccgagcctgctggtgagaagttaacccgggcgctgaccacactcgagccgggggagacgtggctggtcaagcccgaacttcttgacgagcaggcggctgccgcaggcctcggtgaaaaccgcctgtggacgcctggcctgcgcgacggtgtcaagcccggttcatggttccacctcaccgaagcgtttggtccggtgctcggcctgatgacggcccgcacacttgaggaggctatcgagttacagaacgccaccgcgttcgggctcaccgccggcctgcactccctcgacgacgatgagatcgccctgtggaaggaccgcgtccaagccgggaacctctacatcaaccgccacatcaccggtgctatcgtccagcgtcaaagcttcggaggctggaaggcctcgtcggttggccccggcgcgaaggctggcggtccccactatgttgcgatgctcggccagtgggccgacgctgccgatgtcccctcgcgcgatactgactcggctgcgtggttggagtgggcgaaggccgatgacacccgcgtgtgggcgcagttgtcgaaggaggtcgacttgtctgggctcgtcagcgaggagaacaccttccggatgcgtcccatcgacgcgctgaccatccgcgttggtgacggcgcactgcccgtcgaggtggagcgtgtgcgcaacgccgcctggacggcaggtgttgagtccgtcgtgatcccagttcacgacatgacacacgaagtcttcgccgccgccgtcgcgtctggtgacatctcaggccgcatccgcgttatcggcgcagcgcctggcctacacgaggccgccgcgacggttctcggctcaacgacggtgctcgacgccccggttgtcgcctcgggtgcccgcgaactgctcaacgtgctccgtgaacaggccgtcagccgcaccaaccaccgttatggccacattaagcactga

SEQ ID NO: 552 - protein, 1101 aa, Unknown
  Obtained from environmental sample
  DOMAIN (60)...(403): Proline dehydrogenase
  DOMAIN (472)...(937): Aldehyde dehydrogenase family
  SITE (737)...(748): Aldehyde dehydrogenases cysteine active site. Prosite id = PS00070
  SITE (878)...(881): N-glycosylation site. Prosite id = PS00001
KEFGTRDAERLGKLVSDPAGLALAVGFVDDVARPQDTAVAAKALAKLGTKAGDASFLSPADRALFRLGAFAAPILPAVVVPAARMRLKQLVGHLVADAGDGLGKHLARTREEGYALNVNLLGEAVLGADEAAARLQRTIDLVKRPDVDYVSIKVSSVAAQLVTWDLEGSKQRVVDELLPLYRAARDHGVFLNLDMEEYRDLALTCAVFTDILARDEFKTLEAGIVLQAYLPDAVGALDDLTEFAQARVDAGGARIKIRLVKGANLAMESVEAELHDWNLATYPNKPDVDANYLRFLDRALDPARTRAVRLGVASHNLFHVALAVLVARTRGVGEAMDIEMLQGMAPAQAAAVRAEVALDGGRVVLYTPAVRDEDFDVAISYLVRRLEENAASQNFLHAQFAGGQGAIAGQEAAFRTAVAAAVPFAPEAIAPRRTPRSQWPNIADEIAADGVFRNSIDTDPAVAAHRNGAAIIIDREQSGYKPVQTLMTTDAETIDAALTRSVAVQQVWAAVPAAARAEALHAIGRRLEAARFDLVAAEVHEAGKTVAEADPEVTEAIDFAHYYAGSALTLDGVTGANFTPDGVTLVTPPWNFPVAIPAGGVLAALAAGSSVIAKPASPTPRCFELVIEAVHAGLDDASATTGLTPEQNRDIVQFIRVSERSLGKQLVTHDAVARVILTGSIETAELFASWKPERPVLAETSGKNSIIVTASSDIDLAVADVLRSAFGHAGQKCSAASLAILVGSVGDPKSATGERFRRQLIDAVKSLAVGAPTTLSTVMGPLTEPAGEKLTRALTTLEPGETWLVKPELLDEQAAAAGLGENRLWTPGLRDGVKPGSWFHLTEAFGPVLGLMTARTLEEAIELQNATAFGLTAGLHSLDDDEIALWKDRVQAGNLYINRHITGAIVQRQSFGGWKASSVGPGAKAGGPHYVAMLGQWADAADVPSRDTDSAAWLEWAKADDTRVWAQLSKEVDLSGLVSEENTFRMRPIDALTIRVGDGALPVEVERVRNAAWTAGVESVVIPVHDMTHEVFAAAVASGDISGRIRVIGAAPGLHEAAATVLGSTTVLDAPVVASGARELLNVLREQAVSRTNHRYGHIKH

SEQ ID NO: 553 - DNA, 1254 bp, Unknown
  Obtained from environmental sample
atgaccgaaaccatcacggaaagcgaaatcgtcgtacttggcgccggcatggtcggcgccgcgacggcgttggagcttcagcgccggggccgccaggtgacactcctcgaccgcaaggcgcccggcgaggagacgtcttacgggaatgccggcgttatcgagggcggcccctatgtgcctctcgcctttccgcgggatccgcgggagattctgcgctttgccggcaatcgccagacggcgcttcatttccattggcgctttctgccccggatcgccccctggctgatcgcgttgttcagcaattcgtccgaaccccggctgcgcgagaacggcgcggccatccaatcgttgacggcgcacgcgcccgcaatgcatgaggacttaatgatcgaggccggcagggcggacctgttgcgcaagacaggctggctacagctttacgcgagcgatgccgcattcgccgccgatagcctgaagcggcgtatcgccgatgaggcaggatgcgactattcggtgctctacactgaagccgccaaggaactcgagccccatctttcgccagcgttccacaaggcggtttactggccgtcgatccgatcggtcgccgatccaggcgcggcaacgaaggcggtggccgaactctttgcagggcagggcggccgcatcgcccggatggaggttctggcggtcgagccgttagcgggcggatggcgcgtgaaaaccgggcaggcggagattgccgcgcggcacgtcgtgatcgctctcggcccgtggtcgatggaccttttgcgcccactcggctaccgcttcccgctggccgtcaagcgcggctatcacctgcatttccgggccaaggggaatgccaccctgtcgcggccggtggtcgacctatccaatggctttgtgatcaccccgatggcgcaaggtatccgcttaacgaccgggatcgaattcgctcatcgcgatgccccgctcacgccggtccagatcgcgcgcgccgagatcgcggcgcgtaggctctttccgctcgaagcgcccgtcgacccggaaccctggatgggccggcgtccgtgcctgccagactcgagacccattatcggacctgcaccgcgccatgacggattgtggctgaatttcggccatgcccatctcggctataccctgggcccggtctccgcgcggctactggccgagttgataaacggagattcgccgatcagcgatccggcgccattcgccgcgacgcgtttctga

SEQ ID NO: 554 - protein, 417 aa, Unknown
  Obtained from environmental sample
  DOMAIN (9)...(399): FAD dependent oxidoreductase
  SITE (102)...(105): N-glycosylation site. Prosite id = PS00001
  SITE (291)...(294): N-glycosylation site. Prosite id = PS00001
MTETITESEIVVLGAGMVGAATALELQRRGRQVTLLDRKAPGEETSYGNAGVIEGGPYVPLAFPRDPREILRFAGNRQTALHFHWRFLPRIAPWLIALFSNSSEPRLRENGAAIQSLTAHAPAMHEDLMIEAGRADLLRKTGWLQLYASDAAFAADSLKRRIADEAGCDYSVLYTEAAKELEPHLSPAFHKAVYWPSIRSVADPGAATKAVAELFAGQGGRIARMEVLAVEPLAGGWRVKTGQAEIAARHVVIALGPWSMDLLRPLGYRFPLAVKRGYHLHFRAKGNATLSRPVVDLSNGFVITPMAQGIRLTTGIEFAHRDAPLTPVQIARAEIAARRLFPLEAPVDPEPWMGRRPCLPDSRPIIGPAPRHDGLWLNFGHAHLGYTLGPVSARLLAELINGDSPISDPAPFAATRF

SEQ ID NO: 555 - DNA, 1242 bp, Unknown
  Obtained from environmental sample
gtgccgcgaagcgacgttcttgtgctgggcgccggtatggtcggcgcctccgttgccgtgcatctcgccaagcggggcgtgtcggcgacgctgatcgaccggcgagcggcgggggaggagacctcgttcggcaatgcgggcctgatcgaagcgagccggatgctgccgatcggattcccgcgcaacgtgcgtgagcttctacggcatgcaagcgggctctcgccgctcagccattttcactggagcgcattgccaggactggctccctttctgtggcggtactgggcggcgtcgcggccggagcggctcgatgcatcggcccgcatcttgcgtccgatgctggcttcggcgccggaggagcacacggcgctagcggcggaagcggggtcttctcgcctgatccgcagggcggggctcctcaagctgtttcgcacggaggagggttttcaggaaaccgccgccgatcgcgcctttgccgatgagttcggcgttccctacgaggtgctggaccgtgacgcggtactcgcgcgggagccgcatttgcggtccgtattccgccgcgccttgttctggccgcacaccgacaattgctccgacccgggcgctttgaccaaatcttatgtcacgctgttcgagaaactgggcggcgtattcgtgcgcggcgacgcgcgaagcctgcatccatttgcgggtgggtggcgcgtcgagaccgacgccgggccggtcgacggccagcaagccgtgatcgcgctcggcccgtggagcatggatgtcgccggcaagttcggcgtccgtgtgccgttcgccgtcaagcgcggctatcacgtgcatcatgcccctgccggcaacgcaacacttagcggaggcgtgctcgattacgaaggcgggtatctgcttctgccgatggagcgcggcatccgcatcacgactggaatcgaattcgctcgccgcgatgcgccgccgacgccggtgcagattacccgtgtattgccggcggcgcacgaattattcccgctcggcgcggcgcttgacgacaagccatggatggggtcgcggccggcgaccccggattccttgcccgttatcggccgcgcgccggggcaaaagagcctatggcttgcgttcggccattcgcatctcggctttacgctcgggccgccgaccggccggctgctgacggaaatgatcctgggcgaaaagcccttcctcgatccggcaccgtttcgcgccgagcggttctag

SEQ ID NO: 556 - protein, 413 aa, Unknown
  Obtained from environmental sample
  DOMAIN (5)...(395): FAD dependent oxidoreductase
  SITE (199)...(202): N-glycosylation site. Prosite id = PS00001
  SITE (287)...(290): N-glycosylation site. Prosite id = PS00001
MPRSDVLVLGAGMVGASVAVHLAKRGVSATLIDRRAAGEETSFGNAGLIEASRMLPIGFPRNVRELLRHASGLSPLSHFHWSALPGLAPFLWRYWAASRPERLDASARILRPMLASAPEEHTALAAEAGSSRLIRRAGLLKLFRTEEGFQETAADRAFADEFGVPYEVLDRDAVLAREPHLRSVFRRALFWPHTDNCSDPGALTKSYVTLFEKLGGVFVRGDARSLHPFAGGWRVETDAGPVDGQQAVIALGPWSMDVAGKFGVRVPFAVKRGYHVHHAPAGNATLSGGVLDYEGGYLLLPMERGIRITTGIEFARRDAPPTPVQITRVLPAAHELFPLGAALDDKPWMGSRPATPDSLPVIGRAPGQKSLWLAFGHSHLGFTLGPPTGRLLTEMILGEKPFLDPAPFRAERF

SEQ ID NO: 557 - DNA, 1260 bp, Unknown
  Obtained from environmental sample
atgacctacgatgttattgttctcggtgctggaattgtcggcgtctcgacagcgattcatttgctgcggcgcggcaggtcggtgctgctgatcgacaagaatgagcctggccgcgaaacctcgttcggcaatgcaggcatcatccagcgcgaaggggtgcgcccgcacgcgttcccgcgcgacctcgcaatgcttatgcaggtcgggctgcacctctctactgcggcccgctatgatccgctggccctgccccggatcgcacctccgctgctgcggtattggtgggagtcctccccaagccactacaggaacatcgtcaagagctatgcgccgctgatcggactttgtatcgacgagcatgccgatctgatcgccgcgtcggacagcgagcatctggtggtccggaaaggctggctgcttggcttcaggaccgaggcgaagctaaagacggaagaagccaaggcacagcaggatttcgatctgttcggggtcaatcacaaactgctctcgggtgacgatgtggcaaccctcgagcccgatttccggatcaagctggccggtgccattcagtggacagatccatggacgatcaaggaccccggcgcgctggtgtcggcctatttcgagtatttcaagtcactgggcggtgcatttcatgcgggcgcggtaaagagcctccagtccacgaacgagggctggactgccgagactgaaaacggcccgctcaagggcaaggaagccgtcgtgacgctcggcccctgggcacccgaggtgcttgagcctctgggctatcgcctgccgcttttcgtcaagcgcgggtaccacatgcactatggaacagagggcggcgccaagctcaacaactggatcatcgatgcagaggtgggctacctccttgcgccgatggaacgcggcatacgcctgacaaccggagcggaatttgcattgcgcgatgccgctccgacgcccatccagatcggccgggcagaaacggcggcaaaacagctgttccccatgggcgcgcaactggacccgacgccgtggaagggtgcccgcccctgtacccccgacatgatgcccattatcggcccggcgcccaaacaccgcggcctctgggcggggattgggcacgcccatcacgggttcaccctgggaccggcaacggggcacctgctggcgcaggtcatgaccggggaaaagcccgttatcgatattgcaccctttgccatggaccggttcgcgggcagctacaggcgatag

SEQ ID NO: 558 - protein, 419 aa, Unknown
  Obtained from environmental sample
  DOMAIN (4)...(395): FAD dependent oxidoreductase
MTYDVIVLGAGIVGVSTAIHLLRRGRSVLLIDKNEPGRETSFGNAGIIQREGVRPHAFPRDLAMLMQVGLHLSTAARYDPLALPRIAPPLLRYWWESSPSHYRNIVKSYAPLIGLCIDEHADLIAASDSEHLVVRKGWLLGFRTEAKLKTEEAKAQQDFDLFGVNHKLLSGDDVATLEPDFRIKLAGAIQWTDPWTIKDPGALVSAYFEYFKSLGGAFHAGAVKSLQSTNEGWTAETENGPLKGKEAVVTLGPWAPEVLEPLGYRLPLFVKRGYHMHYGTEGGAKLNNWIIDAEVGYLLAPMERGIRLTTGAEFALRDAAPTPIQIGRAETAAKQLFPMGAQLDPTPWKGARPCTPDMMPIIGPAPKHRGLWAGIGHAHHGFTLGPATGHLLAQVMTGEKPVIDIAPFAMDRFAGSYRR

SEQ ID NO: 559 - DNA, 1260 bp, Unknown; identical to SEQ ID NO: 557
  Obtained from environmental sample

SEQ ID NO: 560 - protein, 419 aa, Unknown; identical to SEQ ID NO: 558
  Obtained from environmental sample
  DOMAIN (4)...(395): FAD dependent oxidoreductase

SEQ ID NO: 561 - DNA, 1230 bp, Unknown
  Obtained from environmental sample
gtggacccgcacgtagtcatcgccggttgcggatttggcggcctgttcgcagcacgcgcgctcgcgggccggccggtgcgcgtcacggtggtcgatcgcacgaaccaccatctgttccagcccctcctgtaccaggtggcgaccgccggcctgtcggcgcccgcggtggccgcgccgatccggcacatccttgccgggcagcgcaacgccactgtgatctacggcgacgcgaccggcatcgacccgggacaacgcgcgctgctgctggacggcggcgagcgcatcgcctacgaccggctcatcctcgccacgggcgccgacaacagctatttcggcaacgacgcctggcgcgagcacgcgcccagcctcaagacgctggaggacgcctacgagatccggcgccgcgtgctgctcgccttcgagcacgccgagcgcgagaccgacgccgcgaagcgcgccgcatggctcaccttcgtcgtgatcggcggcggcgccacgggcgtggagctcgccggcgcgttcgccgagatcgcgcgccacacgctgccgggcgagttccggcgcttcgacccgcgcaacgcgcgcgtggtgctggtcgaaggcatcgaccgcgtgctgccgtcctacccggacacgctctcggagaaggcgcgcaagcagctcgagcgcctgggcgtcaccgtgtggctgggcaagcgcgtgaccgcgatcgacgcggagggcgtgtcgctcgggccggatcgcctcgcggcgcgcaccgtgatctgggccgcgggcgtggccgcctcgccgctcggcaagagcctcggcgtgccgctcgaccgcgcggggcgcgtgatcgtgaacgaggacctgaccgtgccgggccacccggagatatccgtgatcggcgacctggccgccctgccctggcaccagccgcccgtgccgggaattgccccggcggccaagcagatgggcaaatacgtggcccggcaaatcctcggaaaaaccggagcgccctatcgctacagggactacggccagctcgccaccatcgggcgcaattcagccgtcggcgtgctcggcaagctgcacctctcgggctacccggcgtggctgctgtggctgctcgcgcacatctacttcctgatcggcttccgcaaccgcatcgtcgtcatgatcgactgggcggcctcgtactggaccttcgagcgccacgcgcgcatcgtgatccgcggcaagccatag

SEQ ID NO: 562 - protein, 409 aa, Unknown
  Obtained from environmental sample
  SIGNAL (1)...(22)
  DOMAIN (4)...(304): Pyridine nucleotide-disulphide oxidoreductase
  DOMAIN (157)...(259): Pyridine nucleotide-disulphide oxidoreductase
  SITE (70)...(73): N-glycosylation site. Prosite id = PS00001
MDPHVVIAGCGFGGLFAARALAGRPVRVTVVDRTNHHLFQPLLYQVATAGLSAPAVAAPIRHILAGQRNATVIYGDATGIDPGQRALLLDGGERIAYDRLILATGADNSYFGNDAWREHAPSLKTLEDAYEIRRRVLLAFEHAERETDAAKRAAWLTFVVIGGGATGVELAGAFAEIARHTLPGEFRRFDPRNARVVLVEGIDRVLPSYPDTLSEKARKQLERLGVTVWLGKRVTAIDAEGVSLGPDRLAARTVIWAAGVAASPLGKSLGVPLDRAGRVIVNEDLTVPGHPEISVIGDLAALPWHQPPVPGIAPAAKQMGKYVARQILGKTGAPYRYRDYGQLATIGRNSAVGVLGKLHLSGYPAWLLWLLAHIYFLIGFRNRIVVMIDWAASYWTFERHARIVIRGKP

SEQ ID NO: 563 - DNA, 717 bp, Unknown
  Obtained from environmental sample
atgttcgcaggcaaggtcatcgccatcacgggcgcgtccgagggcatcggcgccgagatggcgcgccagctcgcgggcaagggcgtgtggctcgcgctcgcggcgcgcaaccagcagaagctggaagccgtcgccgccgactgccgctcgcgcggcgccgaggcggtggccgtgcggtgcgacgtgagcgtgcccgaggactgccgccagttcatcgagatcgcggtgcgcaagtacagctcgctcgacatactcgtgaacaacgccggcgtgtcggggcatgcgcgcctggaggacgtctccgacttcgcctggtacgagcagatgatgaaggtgaactacttcggcacgctgcactgcacgcgcttcgcgctgccgcacctcaggcagcggcgcggcctgctggtgggcatctccagcctcgccggcaaggtcggcgtgccggggcgcaccgcctacagcccgtccaaggccgcgcaggcgctgttcctggaagcgctgcgcctggagctgctggagagcggcgtggacgtgaccatcgtctatccgggcgtggtgcagaccgacatccggctgcacggctacggggccgacggccggcaggccggctacagcgggctgaaggaagacaacgcgatgaccgtgcaggcgtgcgcgcgccagatcctggacgcgatgcgcgagcgccgccgcgagctggctcgtgccgaattcttt

SEQ ID NO: 564 - protein, 239 aa, Unknown
  Obtained from environmental sample
  DOMAIN (5)...(172): short chain dehydrogenase
  DOMAIN (6)...(175): KR domain
MFAGKVIAITGASEGIGAEMARQLAGKGVWLALAARNQQKLEAVAADCRSRGAEAVAVRCDVSVPEDCRQFIEIAVRKYSSLDILVNNAGVSGHARLEDVSDFAWYEQMMKVNYFGTLHCTRFALPHLRQRRGLLVGISSLAGKVGVPGRTAYSPSKAAQALFLEALRLELLESGVDVTIVYPGVVQTDIRLHGYGADGRQAGYSGLKEDNAMTVQACARQILDAMRERRRELARAEFF

SEQ ID NO: 565 - DNA, 1254 bp, Unknown
  Obtained from environmental sample
atgaccgaaaccatcacggaaagcgaaatcgtcgtacttggcgccggcatggtcggcgccgcgacggcgttggagcttcagcgccggggccgccaggtgacactcctcgaccgcaaggcgcccggcgaggagacgtcttacgggaatgccggcgttatcgagggcggcccctatgtgcctctcgcctttccgcgggatccgcgggagattctgcgctttgccggcaatcgccagacggcgcttcatttccattggcgctttctgccccggatcgccccctggctgttcgcgttgttcagcaattcgtccgaaccccgccttcgcgagaacggcgcggccatccaatcgttgacggcgcacgcgcccgcaatgcatgaggaattgctgatcgaggccggcagggcggacctgttgcgcaagacaggctggctacagctttacgcgagcgatgccgcattcgccgccgatagcctgaaacggcgtatcgccgatgaggcaggatgcgactattcggtgctcgacactgaagccgccaaggagctcgagccccatctttcgccagcgttccacaaggcggtttactggccgtcgatccgatcggtcgccgatccaggcgcggcaacgaaggcggtggccgaactctttgcagggcagggcggccgcatcgcccggatggaggttctggcggtcgagccgttagcgggcggatggcgcgtgaaaaccgggcaggcggagattgccgcgcggcacgtcgtgatcgctctcggcccgtggtcgatggacctgttgcgcccgctcggctaccgcttcccgctggccgtcaagcgcggctatcacctgcatttccgggccaaggggaatgccaccctgtcgcggccggtggtcgacctatccaatggctttgtgatcaccccgatggcgcaaggtatccgcttaacgaccgggatcgaattcgctcatcgcgatgccccgctcacgccggtccagatcgcgcgcgccgagatcgcggcgcgtaggctctttccgctcgaagcgcccgtcgacccggaaccctggatgggccggcgtccgtgcctgccagactcgcgacccattatcggacctgcgccgcgccatgacggattgtggctgaatttcggccatgcccatctcggctataccctgggcccggtctccgcgcggctactggccgagttgataaacggagattcgccgatcagcgatccggcgccattcgccccgacgcgtttctga

SEQ ID NO: 566 - protein, 417 aa, Unknown
  Obtained from environmental sample
  DOMAIN (9)...(399): FAD dependent oxidoreductase
  SITE (102)...(105): N-glycosylation site. Prosite id = PS00001
  SITE (291)...(294): N-glycosylation site. Prosite id = PS00001
MTETITESEIVVLGAGMVGAATALELQRRGRQVTLLDRKAPGEETSYGNAGVIEGGPYVPLAFPRDPREILRFAGNRQTALHFHWRFLPRIAPWLFALFSNSSEPRLRENGAAIQSLTAHAPAMHEELLIEAGRADLLRKTGWLQLYASDAAFAADSLKRRIADEAGCDYSVLDTEAAKELEPHLSPAFHKAVYWPSIRSVADPGAATKAVAELFAGQGGRIARMEVLAVEPLAGGWRVKTGQAEIAARHVVIALGPWSMDLLRPLGYRFPLAVKRGYHLHFRAKGNATLSRPVVDLSNGFVITPMAQGIRLTTGIEFAHRDAPLTPVQIARAEIAARRLFPLEAPVDPEPWMGRRPCLPDSRPIIGPAPRHDGLWLNFGHAHLGYTLGPVSARLLAELINGDSPISDPAPFAPTRF

SEQ ID NO: 567 - DNA, 1344 bp, Unknown
  Obtained from environmental sample
atgcgagtggtggtactgggcgccggcatcatcggcacatcgacggcatggcacctgctgcagcgcgggcacgaggtggtgctggtggaccgccagcccgacgcggcgctggagacgagctttgccaacgcggcgcagatttcggtgagctactgcgagccctgggccaaccgccaggcgccgctgaaggcgctgaagtggatgttcgacaagcaggcaccgctgctgtggcgcccgcagctcgacccggcgcagtggcgctggctgttgcagtttctgggccagtgcacggaccgcgccttcgagcgcaacgtggcgcagctggtggcgctgggcgcgtacagccacgccacgctcaagcagatggtggccgaaaccggcatcgactaccagcgcagcgagcgtggcatcgcccacgtgtacaccgatgccaaggcgtttgaagaggccgggcaggcggccgagctgatgcgccgccacggtgtgcagcggcgcgtggtttcacgcgaggagctgttgcgcatcgagcctgcgctggcaccggtggccgaccgcattgccggcggcacctacacccccaccgacgagcatggcgacgcgcgtgtgttcacccaggcgctggcccgactgtgtgccgcgcgcggcgctgagctgcgcttcggccatgacgttgagcggctggaggtggacggcggcgcggtgcgacgcgtgtgggtgcgcgcgcgcgccgacgggcgtgtatcggcgctgcaggccgatgcctacgtggtggcctgcggctcatacaccacgccgttgttggcgacagtcggaatgcgtgtgccgatctaccccggcaaaggctacagtgccacgctggctttgcgtgacccggcacgtgcgccgcaggtgagcctgctcgacgatggccgcaagatcgccatctcgcgcctgggtgaccggctgcgcgtggcgggcaccatcgagctggcaggctacgacctgcgtctggacaccccggtggcgcgtgcccgttgtcacatgttgctgcagcgcatcgaagagctgttccctggtgtggccgacacccgcacacccgagcagggcggcgagccgcagttctggtgcggcctgcgcccggccacgcccaccaacatcccgctcatcggccgcctgccgctgggccggctctggatcaacgccggtcacggcacgctgggctggacgcacggcgccggctcgggccgtgccttggccgaactgatcagcggcgagcgcccggcgctggcgatgcgtttcgtcggcttcgacgaacgcccccgcgcagccacgggtgcagccgccgtctcttctgccgtggggtga

SEQ ID NO: 568 - protein, 447 aa, Unknown
  Obtained from environmental sample
  DOMAIN (2)...(414): FAD dependent oxidoreductase
MRVVVLGAGIIGTSTAWHLLQRGHEVVLVDRQPDAALETSFANAAQISVSYCEPWANRQAPLKALKWMFDKQAPLLWRPQLDPAQWRWLLQFLGQCTDRAFERNVAQLVALGAYSHATLKQMVAETGIDYQRSERGIAHVYTDAKAFEEAGQAAELMRRHGVQRRVVSREELLRIEPALAPVADRIAGGTYTPTDEHGDARVFTQALARLCAARGAELRFGHDVERLEVDGGAVRRVWVRARADGRVSALQADAYVVACGSYTTPLLATVGMRVPIYPGKGYSATLALRDPARAPQVSLLDDGRKIAISRLGDRLRVAGTIELAGYDLRLDTPVARARCHMLLQRIEELFPGVADTRTPEQGGEPQFWCGLRPATPTNIPLIGRLPLGRLWINAGHGTLGWTHGAGSGRALAELISGERPALAMRFVGFDERPRAATGAAAVSSAVG

SEQ ID NO: 569 - DNA, 1260 bp, Unknown
  Obtained from environmental sample
gtgcgcgtactgattctcgggagcgggctggccggtgtgacgtccgcctactacctgcgcaagcacggatgcgacgtcaccgtcgtagaccgcgccgcgggcgcggggcgcgaaacgagcttcgcaaacggatcgatgatcacgccgagtctcgcggatccgtggaatgcaccgggtgtgttcggcgcactagtccgctcgttgggacgtgaggattcggcgatcctgctgcgcgtcgcggcgattccgtcgctgttcggctggggcatctcgttcctgaggaactccgcgtcgaagcgcttcgaacgcaactaccttcgtaacgtcggactggtgcattactcgcaaaaggtcatgcgggatctcatgcagacgcatgcgctgaaattcgactacgtcgacgacggcacgatgaagatcttccgcgacgaggcttcgttcgatcacggcatcaagatcgcgcattggttgaaacaggtgggaatagaacatcgccagctcgatgccgacggcgttgtgaggatcgaaccgaacctcgcgccggtagcggaccagatcgtcggaggcatcggttatccgggcgacgaaaccggcaacgcgcggatgttctgcgaggaaatgcggcgcgtgtgcgaggaatcgggcgtgcgcttccgtttcgccgagaacgtggtggagatcatccgcaagcgcaagagaatcgagggcctgcgaaccgcaaagcagacgttgtccgccgatgcatacgtgctggcggcgggcagcttcagcgcgaactggagcaagcagctcggcttcgacattccggttcgtcccgcaaagggatactccatttcgataccgatgcaccgttgggagccgaggccgcgcgtgccggtagtggacgattcgctgcacgctgcgctggtgccggtgggtggcgtgttgcgcgtggccggcacggccgaattcaccggctacgacgttacggtgaatccgaaacgtattgcgaatctcgtcaatctgttcggccgcgtgtatccgaagctcgccgaacgcgtgggcgatctcgacgtgcagccgtggtgcggcttgcggccgctaacgccggacggcatgccgatcgtgagcagatccccggtcgaaaacctctacctcaacaccggccacggcccgttgggctggtcgatggcgtgcggatcgggtcaggcgatcgcagacatgatcacgggcaatccgaccgcaatagacatgactaccttcgccttgcaacgcttctga

SEQ ID NO: 570 - protein, 419 aa, Unknown
  Obtained from environmental sample
  DOMAIN (2)...(401): FAD dependent oxidoreductase
  SITE (43)...(46): N-glycosylation site. Prosite id = PS00001
MRVLILGSGLAGVTSAYYLRKHGCDVTVVDRAAGAGRETSFANGSMITPSLADPWNAPGVFGALVRSLGREDSAILLRVAAIPSLFGWGISFLRNSASKRFERNYLRNVGLVHYSQKVMRDLMQTHALKFDYVDDGTMKIFRDEASFDHGIKIAHWLKQVGIEHRQLDADGVVRIEPNLAPVADQIVGGIGYPGDETGNARMFCEEMRRVCEESGVRFRFAENVVEIIRKRKRIEGLRTAKQTLSADAYVLAAGSFSANWSKQLGFDIPVRPAKGYSISIPMHRWEPRPRVPVVDDSLHAALVPVGGVLRVAGTAEFTGYDVTVNPKRIANLVNLFGRVYPKLAERVGDLDVQPWCGLRPLTPDGMPIVSRSPVENLYLNTGHGPLGWSMACGSGQAIADMITGNPTAIDMTTFALQRF

SEQ ID NO: 571 - DNA, 1248 bp, Unknown
  Obtained from environmental sample
atgaagattgtgattctcggtgccggcgtgatcggcgtcaccaccgcctggtatctggcaaagaccggacatgaggtcacggtgctcgaccggcagtccggcgccgcgctcgaaaccagttttgccaatgccggcgaggtctcgcccggctactcctcgccctgggcggcgcccggcattccgcaaaaggcgctcaagtggctcttcatggaacatgccccgctgatcgtgcgtccgaccatagatcccgccacggtacgctggatgctctccatgctgcgcaactgcacgaaggcccgctacacgcgcaacaaggggcgcatggtgcgggtcgccgaatattcgcgcgactgcctgatcgacttgcgggcggagaccggcatccagtatgatcagcgcacgcaaggcacgctggaggtctttcgtagtcagaaacaactcgacaatatcggcaaggatgttgaggtgctgaaggccggcggcgtgccgttcgagatactggacgcggccggctgtgcccgtgccgaacccggtatcgacgccagcaaaatcgtcggcgggctgcgactgcccaatgacgagaccggcgactgccacaagttcaccaccgccctcgccgccctcgctgaggccgccggcgtgcgcttcatatataatgtcgatattcgcggcctgcgccatgacgggcggcagatcaccgccgtggagaccgaccagggcgaatatatagcccatgtctttgtcggtgcgctcggcagctatacgccgaaactggtaaagccgcttggcctcgacttgccggtctatccggtgaaaggctattcgatcaccgtgccgatcatcaatgaggcccgtgccccggtgtcgaccgtgatggacgagacctacaaggtggccatcacccgcctgggcgatcgtatacgtatcggcggcatggccgagatcgcccgcttcaatatggatctgccgcccgcccgccaggccaccctcacccattccgtcgaggatctgttcaccggcgccggcgatcagtcacaggcgaaattctggtgcggtttgcgcccgatgacgcccgacggcacaccggtgatcggacgcacgcgctatgacaatttctggctcaataccggccatggcacgctcggctggaccatgtcctgcggctcggcgcgcgtattggccgatatgatcagtggcgtgaagccggagattgaaaccggcgacctgtcgatcagccgctacacttaa

SEQ ID NO: 572 - protein, 415 aa, Unknown
  Obtained from environmental sample
  DOMAIN (2)...(396): FAD dependent oxidoreductase
  SITE (96)...(99): N-glycosylation site. Prosite id = PS00001
MKIVILGAGVIGVTTAWYLAKTGHEVTVLDRQSGAALETSFANAGEVSPGYSSPWAAPGIPQKALKWLFMEHAPLIVRPTIDPATVRWMLSMLRNCTKARYTRNKGRMVRVAEYSRDCLIDLRAETGIQYDQRTQGTLEVFRSQKQLDNIGKDVEVLKAGGVPFEILDAAGCARAEPGIDASKIVGGLRLPNDETGDCHKFTTALAALAEAAGVRFIYNVDIRGLRHDGRQITAVETDQGEYIAHVFVGALGSYTPKLVKPLGLDLPVYPVKGYSITVPIINEARAPVSTVMDETYKVAITRLGDRIRIGGMAEIARFNMDLPPARQATLTHSVEDLFTGAGDQSQAKFWCGLRPMTPDGTPVIGRTRYDNFWLNTGHGTLGWTMSCGSARVLADMISGVKPEIETGDLSISRYT

SEQ ID NO: 573 - DNA, 1263 bp, Unknown
  Obtained from environmental sample
atgagcagaccgcgttccgtgatcatctgcggcgggggcatcgtcggcctctgcaccgcctactccctcgcccgcgagggcttccgggtgaccgtgctcgagcgcaacgcggagggcgcggactcctgcgcgcagggcagcgccggctatgtctcgccgagccacgtgatgccgctgtcggcgcccggcatggtctggcaggggctgaagtggatgacgaatccgcgcagtccgttctacatccagccgcggctggacggcgacctgttgcgctggggctggctgtttgcccgcgcctgcacgcgcggccacatgcgccgggcggcgcccctgctgcgcgacctgtgtctcgacggccgggcgcgtttcgttgaattggcggacatcacgggcaacgccttcgagctgcagaccgagggcattctgaatctctgccagactccggccgggctggagcacgaggcccgcgggctgggccggttggcgaacgacgtgggcatcgaggcccgggtgctcgatgcggcgcagacggcggcgctggagccgggcacgaagctggcggtggccggctcggtttattttcccatcgatgcgcacctgacgccgcggaagctggtgcccgcgctcaccggcctgctgcgcgagatgggggtgaagttccagtggaacaccagcgtgtacggctggcgcgccgaggccgggcgcatcgccgccgtgcacacgaccagcggcgatctggtggccgacgagtatgtgctcacgggcgggtcgtggtcgccgggcatggtggcgggcctcgacgtgcggctgccgatgcagccgggcaagggttatagcctgacgctggagcgcccgccgttccggctgacgaagtcgatgattctcgtggagcgccgcgtggcgatcacgcccatgggcggcgcgctgcgctttggcgggacgatggagatcagcggccacaacgaccgcgtccggcccgagcgcgtggagcagatcatcgccggggcctgtgcttttctgcccgagttggcggcgaaggattttgccggggtgcagccctggttcggctaccggccggtgtcgccggacggtctaccgtacctcgggcgcttccgtgcgcaccgcaacctgacggccgcctgcgggcatgcgatgctcggcgtgacgctggcgccgtcgagcggcgccctcgtcgccgatctgctgacggggcgcaagcccgccattccgctcggcctgctttcccctgatcgctacgcctga

SEQ ID NO: 574 - protein, 420 aa, Unknown
  Obtained from environmental sample
  SIGNAL (1)...(24)
  DOMAIN (6)...(401): FAD dependent oxidoreductase
  SITE (226)...(229): N-glycosylation site. Prosite id = PS00001
  SITE (381)...(384): N-glycosylation site. Prosite id = PS00001
MSRPRSVIICGGGIVGLCTAYSLAREGFRVTVLERNAEGADSCAQGSAGYVSPSHVMPLSAPGMVWQGLKWMTNPRSPFYIQPRLDGDLLRWGWLFARACTRGHMRRAAPLLRDLCLDGRARFVELADITGNAFELQTEGILNLCQTPAGLEHEARGLGRLANDVGIEARVLDAAQTAALEPGTKLAVAGSVYFPIDAHLTPRKLVPALTGLLREMGVKFQWNTSVYGWRAEAGRIAAVHTTSGDLVADEYVLTGGSWSPGMVAGLDVRLPMQPGKGYSLTLERPPFRLTKSMILVERRVAITPMGGALRFGGTMEISGHNDRVRPERVEQIIAGACAFLPELAAKDFAGVQPWFGYRPVSPDGLPYLGRFRAHRNLTAACGHAMLGVTLAPSSGALVADLLTGRKPAIPLGLLSPDRYA

SEQ ID NO: 575 - DNA, 1584 bp, Unknown
  Obtained from environmental sample
atgaaacccgacggcggctccctgatcggcttcggctccggcggggccggggcttcgttccaggcctttgatcccgtgcgcggcgtcgcccttgagccgtcttttccgtcggccacgccggcggatatcgagcgggccgtgaagttggccgccgcggcggcgccggaactcgcgcgccggaccggggcggagcggaaccgtttcctgcgggccatcgccgacaacctggaggccaagggtgcggacttggtcgaccgggcggtgcaggagacgggtttggccgcggcgcggctgaccggggagatcggtcgcacggcccagcaactccggctctacggcgccgccgcggaggcgggcgactggctggacgcgcggatcgagacggcccgccccgaacgccggcccttgccgcggccggatcaccgctcgatgcgacgtccgctcgggccggtggtcgtgttcggtgcgagcaattttccctttgcctactcggtggccggcggggacacggcgtcggcgttcgcggccggctgtccggtgatcgtcaaggcgcacccggcgcatcccggcacgggcgagctggtcggccggctgattttgcacgccgtgcgggatctcggctggccggagggcacgttttcgctgctgttcgacgcggggttcgcggtcgggcaggcgctggtgcagcatccgctggtccgggcggtgggcttcaccggttcgctgcgcggcgggcgggcgctggcggatctcgccgcggcgcggccggagccgattcctgtctatgccgagatgggcagcatcaatcccgtcttcctgctgcccggcgcgctggccgagcgggcggagacgctggccgaggggttgcaggcctcggccacggcgagcgccggccagttttgcaccaatcccgggctgatcgtgctgccgcgcacggcggcggcggagcggtttgtcgaggagctgctgcggcggctggcatcgaccccggcggcaccgatgctgacgcccggcatccgccggcagttcgaggtggcgaccgcggagcgcgcggcgctgaccggcgtgcggccgctgcggccggggggcggagtggtcgccggcggcgtgacgccgcgctggtttgagacggacgcggcggtcttccggggcacgccggcgctggcggaggagattttcggcccgagttcgctcgtggtctggtgccgggacgcggtcgagatgcgcgcggtggcggaggcgttgcccggcagtctgaccgcgtcggtgcattgcagcgccggcgaggcggaggcggcgcgcggcctgctggatctgctcgcggagaaggcgggccggctgatcgtgaacggctggccgacggggttggaggtcagcgacgccatcgtgcacgccgggccctatccggcgacgagtgacggcgggcggagcacgtcggtcggcacgcgtgcgctcgaacggtgggggcgattggtctgttatcagaacacgcccgacgacctcttgccgccggagctgcgcaacgccaatccgctcgggctgcgtcggcaggtggacggcgagtggaccgggcgcggctggtag

SEQ ID NO: 576 - protein, 527 aa, Unknown
  Obtained from environmental sample
  DOMAIN (11)...(492): Aldehyde dehydrogenase family
MKPDGGSLIGFGSGGAGASFQAFDPVRGVALEPSFPSATPADIERAVKLAAAAAPELARRTGAERNRFLRAIADNLEAKGADLVDRAVQETGLAAARLTGEIGRTAQQLRLYGAAAEAGDWLDARIETARPERRPLPRPDHRSMRRPLGPVVVFGASNFPFAYSVAGGDTASAFAAGCPVIVKAHPAHPGTGELVGRLILHAVRDLGWPEGTFSLLFDAGFAVGQALVQHPLVRAVGFTGSLRGGRALADLAAARPEPIPVYAEMGSINPVFLLPGALAERAETLAEGLQASATASAGQFCTNPGLIVLPRTAAAERFVEELLRRLASTPAAPMLTPGIRRQFEVATAERAALTGVRPLRPGGGVVAGGVTPRWFETDAAVFRGTPALAEEIFGPSSLVVWCRDAVEMRAVAEALPGSLTASVHCSAGEAEAARGLLDLLAEKAGRLIVNGWPTGLEVSDAIVHAGPYPATSDGGRSTSVGTRALERWGRLVCYQNTPDDLLPPELRNANPLGLRRQVDGEWTGRGW

SEQ ID NO: 577 - DNA, 1239 bp, Unknown
  Obtained from environmental sample
atggcagcggacgcaatcgttctgggcgcggggattatcggggtgtcgactgcacttcatctggcaaggcgcggcaaatccgtggtgctggtggaccggcgcggccccggcgaggaaacctcgttcggcaatgccggcctcatccagcgcgaaggcgtggtgccctacgcctttccccagcagatcggcatgatcctcaaggtggcgctcaacaaccgcatcgacgtgcggtatgatttcggcgcacttccagcggttgccaaattcctcggccgttactggtggcactccaatacgggtcgccaccaggtgatcgcccgctcttatgcgacactgatcgaacagtcgattgcagagcatgacgacctgatccaagcatcgggtgcagaaaacctcatccgcaaggatggctggacgcaagcctttcgcacgcgggcgaagcaggatggcgaggttgccgaagccgagcgtctgaagcgcgaatacgacctcgatttcaaggtgctggatgccgccgaactcgcggccaaggagccgcatctcagcagtgatttcgtcggcggcctcacctgggtcgatccctggtcggtgaccgatccgcacgcgctgacactcgcctatgtcaaactgttcgaaagcctcggcggccggttcgtcaagggcgacgcgacaagccttgcccagaccgcgaccggctggaaagttttgaccgataacggccccgtcgagggcaaggacgtggtgatcgcgctcggcccctggtcagacacggtaacgaagccgctcggctataaattccttgtcggcgtcaagcgcggctatcacatgcattacggcctctccgacaacaaggtgctgaacggctggaccatggatgccgagcgcggttattttctcgccccaatggacaagggcataaggctgacgacgggcgccgaatttgcacttcgcgacgcgccgaagacgccagtgcaactgggccgcgccgaagccgttgcccgcaccatctttccgctcggggaacggctggacaaggagccctggatgggcgcgcgcccctgcaccccggacatgatgcccatcatcggcaaggcaccgcgccatgaaggtctgtggtttgccttcggccatgcccatcacggcctgacccttggcccggtcaccggccgggtgattgccgaacagatctgcggagaaaaaccctttatagacaccacaccataccggcccgagcggttc

SEQ ID NO: 578 - protein, 413 aa, Unknown
  Obtained from environmental sample
  DOMAIN (4)...(395): FAD dependent oxidoreductase
MAADAIVLGAGIIGVSTALHLARRGKSVVLVDRRGPGEETSFGNAGLIQREGVVPYAFPQQIGMILKVALNNRIDVRYDFGALPAVAKFLGRYWWHSNTGRHQVIARSYATLIEQSIAEHDDLIQASGAENLIRKDGWTQAFRTRAKQDGEVAEAERLKREYDLDFKVLDAAELAAKEPHLSSDFVGGLTWVDPWSVTDPHALTLAYVKLFESLGGRFVKGDATSLAQTATGWKVLTDNGPVEGKDVVIALGPWSDTVTKPLGYKFLVGVKRGYHMHYGLSDNKVLNGWTMDAERGYFLAPMDKGIRLTTGAEFALRDAPKTPVQLGRAEAVARTIFPLGERLDKEPWMGARPCTPDMMPIIGKAPRHEGLWFAFGHAHHGLTLGPVTGRVIAEQICGEKPFIDTTPYRPERF

SEQ ID NO: 579 - DNA, 1254 bp, Unknown
  Obtained from environmental sample
atgaagatcaccattctcggagccggcgtcatcggcgtcacctcggcctattacctcgcaaaggctggccatgaggtgacggttctcgaccgacaggccgggccggcgctggaaaccagctttgccaatgccggcgaagtgtcctttggctactgctcaccctgggccgcccccggaattccgcaaaaggcgctcaaatggatctttatggagcatgcaccgctgatcctgcgccccaagctcgatgtcgccatgctgtcctggatgttccgcatgctctccaactgcacatcggagcgttatgcgctgaacaagagccgtatgctcaggcttgccgattacagccgtctggcgcttgccgaagtgcgcgccgacacagccatcgcctatgacgaacgcatgcagggcacgctgcaattgtttcggaccgaagcacagctggaagcatcggccaaggatgtgaaggcgctcgccgccgatggtattccttacgaagttctcgatcccgccggctgcatccgcactgagccagcgcttgcccatgtccgcgaaaagatcgtcggcggccttttgaccccgaaggacgagacgggcgactgcttcaagttcaccaatgcgcttgcgaaaaaggccgaagaactcggcgtcaccttccagtggggcgtcgatatcaaggcgctcgaagtgtccggcggcacggtcaagggcgtgatcaccggtcgcggccgcatgacgagcgatgccgtggtggtggcgctcggcagttattcgcccttgctggtgaaaccgcacggcatcggcctgccggtctatccggtaaaaggctattcgctcaccatcccgatcaccgatgccagccgcgcaccggaatccaccgtgatggacgagacctacaagattgccatcacgcgcctgggtgaccgcatccgcgttggcggcatggccgaaatttcgggctataccaatgatctcggccttgcccgccgccgcacgctcgaacattccgtgacggatcttttccccggcggcgatgtgaagaaggcggatttctggtcgggccttcgcccgatgacgccggacggtacgcctgttatcggcgcgaccaaggtgcgcaacctcttcctcaacaccggccatggcacgctcggctggacgatgagctgcggctcggccaaggtgctcgccgatatcgtcagtggccgaacggccgatatcgagacgaaggatcttgccgtcgcgcgttacgccgcctga

SEQ ID NO: 580 - protein, 417 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
  SITE (105)...(108): N-glycosylation site. Prosite id = PS00001
MKITILGAGVIGVTSAYYLAKAGHEVTVLDRQAGPALETSFANAGEVSFGYCSPWAAPGIPQKALKWIFMEHAPLILRPKLDVAMLSWMFRMLSNCTSERYALNKSRMLRLADYSRLALAEVRADTAIAYDERMQGTLQLFRTEAQLEASAKDVKALAADGIPYEVLDPAGCIRTEPALAHVREKIVGGLLTPKDETGDCFKFTNALAKKAEELGVTFQWGVDIKALEVSGGTVKGVITGRGRMTSDAVVVALGSYSPLLVKPHGIGLPVYPVKGYSLTIPITDASRAPESTVMDETYKIAITRLGDRIRVGGMAEISGYTNDLGLARRRTLEHSVTDLFPGGDVKKADFWSGLRPMTPDGTPVIGATKVRNLFLNTGHGTLGWTMSCGSAKVLADIVSGRTADIETKDLAVARYAA

SEQ ID NO: 581 - DNA, 1260 bp, Unknown
  Obtained from environmental sample
atgaagccggacgtgattgtactcggcgccggaatggtcggcgtctcgacggctctccatcttcaaagtcgcggccatgacgtggttctggtcgaccgccgtccacccggcgaggaaacctcgttcggcaatgccggggtcatccagcgcgaggccgtggaaccctatgccttcccccggtccgcgctgcagctcctgcgcttcgcgtgcaagaccggcccggaggtgaactatcattttcgcgccctgcccggtctggtggggccgcttctgcggtactggtggttttccgcgcccgcccgctaccccgccatcgccgccgcgcatgcaaggctgatcgagcactgccttggcgagcacgaggtgctgatcgggcaggccggggcggacgatctggtgcggcgcgacggtttccgctttgtctatagatccgccagggccctggagaccgacgcggcgcaagcccggcaactggcacaagaccatggccttgcctgcgatcttcttgacggcgatgccctggcacgggccgagccggcgctgaaacagccgctggctggcgcgcttcactggcgcgatccctggacggtcagctcgccgggagagcttgtcgtccgctatgccgcgctgttccggcggaagggcggtaccgtgctgaccggcgatgcggcaagcctggcccggcatggaaatatcggctgggcggtgatgacggacgacggcaagctggaggctgccaatgcggtgattgcgcttggcccctggtcggtggagaccgcaaggcgcctcggataccgactgcctctgttcgtcaagcgcggctatcatcgccactaccggcccccggatggcgccgcgcggctggcactgccgatgctggatgcgcagaagggggtcgtgctggcgcccatggcacaggggctgcggattaccaccggcgccgaattcgcccggctcgaagcgccttcgacgccggtgcagatcgacggtgccgcccgggcggcggccgagttgctggatatcggcacgccggtcgagccggcaccgtggcgtggcgcacggccatgcaccccggacatgctgccggtggtcggtgccgcgccgcgccacaatggcctgtggttccatttcggtcatgcccatcagggcttcacgctcggccccgtcaccggcaggctcatcgcggagatgatcgggggcgaacgccccttcctcgacccgtcaccctatgccgtcacccgctttgctggcgggcgctga

SEQ ID NO: 582 - protein, 419 aa, Unknown
  Obtained from environmental sample
  DOMAIN (4)...(397): FAD dependent oxidoreductase
MKPDVIVLGAGMVGVSTALHLQSRGHDVVLVDRRPPGEETSFGNAGVIQREAVEPYAFPRSALQLLRFACKTGPEVNYHFRALPGLVGPLLRYWWFSAPARYPAIAAAHARLIEHCLGEHEVLIGQAGADDLVRRDGFRFVYRSARALETDAAQARQLAQDHGLACDLLDGDALARAEPALKQPLAGALHWRDPWTVSSPGELVVRYAALFRRKGGTVLTGDAASLARHGNIGWAVMTDDGKLEAANAVIALGPWSVETARRLGYRLPLFVKRGYHRHYRPPDGAARLALPMLDAQKGVVLAPMAQGLRITTGAEFARLEAPSTPVQIDGAARAAAELLDIGTPVEPAPWRGARPCTPDMLPVVGAAPRHNGLWFHFGHAHQGFTLGPVTGRLIAEMIGGERPFLDPSPYAVTRFAGGR

SEQ ID NO: 583 - DNA, 1233 bp, Unknown
  Obtained from environmental sample
atgagattcgataccgtggtgctcggcgccggcatagtcggcgtgtgcgtggcggtgcatcttcagcaacgcggtcgcgcggttgcgttgatcgatcgcaagcagcccggcaatgaaacgtcattcggcaacgccggactgatccagcgcgaaggcgtctatccgtacgcttttccgcgcggactcggcacgttgctgcgctatgcgcgcaaccagtcgcccgacgttcgctatcacgccgacgcgatgctcgaagccgtgccgttcctgtggcgctactggcgcaattctcatcccgcgaagcatgcacggatcgcacggtcgtacgcgacgctgatcgagcattgcgtgaccgaacaccgcgcgctcgccgccgcggccggtgcgagtgcgctgctgcgtccgatcggctggatcaaggtatttcgcaaccatgcggcacgggaggccgaaatccggcttgccgagcaatggcaccgcgaatatggcgtcgaattcgaagcgctcgacgcgccgcgcctgcaacaactcgaacccgacctcgacaagcgtctgcaaggcggtctgcgctatccgcaagcggactccgtcagcgatccgaatgcgctcgtcaccgcgtacgcgcggtatttcgaagcgctcggcggacggttttttttcggcgatgcggcgacgctgcgcgagggctggcaagtcgatacccaacaggaccccgtcaccgccgactcggtggtcgtggcgctcgggccgtggtcggaccggctggtctcgcggctcggctaccggctgccgctcgcggtaaagcgtggatatcacatgcactacgcgccgcgccaaaccacccggctcaatcatccggtgctcgatgccgaatacggttatgtgctggcgccgatggctcgcggtatccgtctgacgacgggcgcggaaatcgcccgttccgacgcagacaaaacgccggtgcaactcgacgcggtcgaaccgatcgcgcgcacgctgttcccgctcggcgagcgtctcgacagcgaaccgtggatgggccgccggccctgtacgccggacatgatgccgatcatcgggccggcgccgcatcatcagggcttgtggttcgcgttcggtcacgcgcaccacggtctgacgctcggtccggtgaccggacggctgatcgccgagatgatgaccggcgagcaaacgctcgtcgatccacggccgtttcgggtggagcgcttctag

SEQ ID NO: 584 - protein, 410 aa, Unknown
  Obtained from environmental sample
  DOMAIN (4)...(392): FAD dependent oxidoreductase
  SITE (38)...(41): N-glycosylation site. Prosite id = PS00001
MRFDTVVLGAGIVGVCVAVHLQQRGRAVALIDRKQPGNETSFGNAGLIQREGVYPYAFPRGLGTLLRYARNQSPDVRYHADAMLEAVPFLWRYWRNSHPAKHARIARSYATLIEHCVTEHRALAAAAGASALLRPIGWIKVFRNHAAREAEIRLAEQWHREYGVEFEALDAPRLQQLEPDLDKRLQGGLRYPQADSVSDPNALVTAYARYFEALGGRFFFGDAATLREGWQVDTQQDPVTADSVVVALGPWSDRLVSRLGYRLPLAVKRGYHMHYAPRQTTRLNHPVLDAEYGYVLAPMARGIRLTTGAEIARSDADKTPVQLDAVEPIARTLFPLGERLDSEPWMGRRPCTPDMMPIIGPAPHHQGLWFAFGHAHHGLTLGPVTGRLIAEMMTGEQTLVDPRPFRVERF

SEQ ID NO: 585 - DNA, 1338 bp, Unknown
  Obtained from environmental sample
atgaaaatcatcgttcttggcgcaggcatcattggcatcagcaccgcttggcatctgctcgagcgcggccatgaggtcaccatcgtcgaccgccaacccgacgccgccctggaaaccagtttcgccaatgcggcacagatttcggtcagctactgcgagccctgggccaaccgcgacgccccggcaaaactcgtgaagtggatgttccgcaacgacgcgccgctgctgttccgtccgcagctggattggcagcaatggcgctggggcctgcaatttctgagccagtgcaatgacgcggccttcgagcgcaacgtgcagcagatcgtggccctgggcgcctacagccatgtggcgctgaaggaaatcgtgcgccagaccggcatcgaatacaaccgcctggagcgcggcatcgcccactactacaccgaccagaagtcgttcgattccgccggctcggccgcggccttgatgcgcaagttcggcgtcgaccgcaaggtggtgagccgcgacgagttgatgcgcatcgagcccgcgttcaaggcgttcgcgcaccgcatcgtcggcggcacctacacggccagcgacgagagcggcgatgcgcgcgtcttcacgcaggaactggccaagcgctgcgcggcgcggggcgcgcagttcctctacaaccacgacgtcatgcgcctgaacaaggatggcgacgctattaaatcagtagctgtacgcgctcgttccaccggcgctgcaggcccaaaagaccaagtattgcaaggcgatgccgtggtcgtggcctgcggctcctacagcgcgccgctgctgcgtaccgtgggcgtggacctgccgatctaccccggcaagggctacagcgcaaccttcaagctgctgcggcccgagctcgcgccgatggtctccaccatcgacgacgaagtgaagtgcgccatgagccgcctgggcgaccacctgcgcgtggccggcaccatcgaggtcggcggctacgacctgtcgctcgacacgccgctggcgcgcgcgcgctgccagatgctggccgaccgcatcgaggccgtgttgcccggcgtctgcgacacgcgcaacgaagcccagggcggccagccgaatttctggaccggcttgcgcccggccacgccgaccaacatcccctacatcggccgcaccagggtcggcaagctgtgggtcaacgccggccacggcacgctgggctggacccacggcgccggttcgggcaaggccatggccgaactcatcagcggcgagcagccggcgatgcagttcggattccatggattcaaggccggccatcgccacggggaaatggcgaacgcctga

SEQ ID NO: 586 - protein, 445 aa, Unknown
  Obtained from environmental sample
  DOMAIN (2)...(418): FAD dependent oxidoreductase
MKIIVLGAGIIGISTAWHLLERGHEVTIVDRQPDAALETSFANAAQISVSYCEPWANRDAPAKLVKWMFRNDAPLLFRPQLDWQQWRWGLQFLSQCNDAAFERNVQQIVALGAYSHVALKEIVRQTGIEYNRLERGIAHYYTDQKSFDSAGSAAALMRKFGVDRKVVSRDELMRIEPAFKAFAHRIVGGTYTASDESGDARVFTQELAKRCAARGAQFLYNHDVMRLNKDGDAIKSVAVRARSTGAAGPKDQVLQGDAVVVACGSYSAPLLRTVGVDLPIYPGKGYSATFKLLRPELAPMVSTIDDEVKCAMSRLGDHLRVAGTIEVGGYDLSLDTPLARARCQMLADRIEAVLPGVCDTRNEAQGGQPNFWTGLRPATPTNIPYIGRTRVGKLWVNAGHGTLGWTHGAGSGKAMAELISGEQPAMQFGFHGFKAGHRHGEMANA

SEQ ID NO: 587 - DNA, 1290 bp, Unknown
  Obtained from environmental sample
atgcgtgccgcccgaacatctcaagtcctctcaatgcaacttcacatcaaccgccaagccgacgtactcgttctcggagcggggatcgtcggcgtctgcaccgccttgcaccttcaggcccgcggtcgcgatgtcatccttgtcgaccggcgctcgcctggagaggagacaagtttcggcaatgccggactgatcgagcggtcttcggtcgtgccctacgcgtttccgagaaacatcggcgctatccttgcctatctgaccaaccgatcgccggcggtgcgctacgacccgcgatttctccccgctatcctgccccggctggttcgctactggtggcattcggcgccgggccgcctggagcgggcagccgaggtgatgctgccgctgatcgagcgcagcgtcgacgaacacgatgcgctgatcaggcaggccgggatggagcgctacgtccgtcgcgaaggctggatcgagctgttccgctcaccggctctcttcgagcgggctaaacgggacgtcgcggctttggaacgcttccgtcttcggttcgatattctcgatgctccgcgtttgcaggaccgcgtgccgtcgctgcgcgacggcgtggccggtggcattcactggctggacccctggtcggtcagcgatcccggcgcggtcacgcgcggatacgcacaactcttcctcgatcgcggcggatcttttctgcgagcggaggcgcgctcgctgcgccggcagcctgaagggtggtcggtggacgacagcgacggcatccagcttggggccaaggaagcggttgtcgcgctcggaccgtggtcggaggaaatctaccggcctctcggataccggttccccatgttcgtcaagcgggggtatcaccgacattacagcgccgaaagcggcgccacgctccggcatccaatttgcgatgtggaagccggtttcgtcctgacgccgatgacgcgcggcataaggctgacgacgggtgtcgaactggcgccgcgagattcgcgcccgacgccgacgcaactcgagctggcggaaacagtcgcgcgcaggatattcccgctcggcaggtccatggaccagacgccctggttgggcgccaggccatgcctgcccgatatgagaccggtgatcggccccgcgccacgtcataaaggtctgtggttcgctttcggacacgcgcatcatggcttcacgctcggtccgatcaccggacgcattctggccgaggcgatgaccggcgaaaagccggcggcggacatatcgcgctacgcggtccgatggtga

SEQ ID NO: 588 - protein, 429 aa, Unknown
  Obtained from environmental sample
  DOMAIN (21)...(412): FAD dependent oxidoreductase
MRAARTSQVLSMQLHINRQADVLVLGAGIVGVCTALHLQARGRDVILVDRRSPGEETSFGNAGLIERSSVVPYAFPRNIGAILAYLTNRSPAVRYDPRFLPAILPRLVRYWWHSAPGRLERAAEVMLPLIERSVDEHDALIRQAGMERYVRREGWIELFRSPALFERAKRDVAALERFRLRFDILDAPRLQDRVPSLRDGVAGGIHWLDPWSVSDPGAVTRGYAQLFLDRGGSFLRAEARSLRRQPEGWSVDDSDGIQLGAKEAVVALGPWSEEIYRPLGYRFPMFVKRGYHRHYSAESGATLRHPICDVEAGFVLTPMTRGIRLTTGVELAPRDSRPTPTQLELAETVARRIFPLGRSMDQTPWLGARPCLPDMRPVIGPAPRHKGLWFAFGHAHHGFTLGPITGRILAEAMTGEKPAADISRYAVRW

SEQ ID NO: 589 - DNA, 1254 bp, Rhodococcus erythropolis DSMZ 44522
atgggaactcgtcagagccccgatcgtgtggtcgtggtcggtgcgggtgttgtcggattgtcgacggcctggttcttgcaggaacgtggagtcgaggtcaccgtcgtcgatcgcgacggcgtcgcagccgacgcgagctggggcaacgccggttggcttgcccccgcattgacgcttccgctgcccgaacccgcagtgctccaatacggcttgcgcgcgatgctcagcccgtcgtccccggtgtacgtgccactgaccaccgatctgaagctgattcggttcctggtcgggttcgcgcgccactgcacgccgtcgaagtggcaggaagcgatgtcggtctacaccgaggtcaaccgaacagccttgggcgcgtacgacgaactcgccgacggtggcgtcaaagagctgacccgcctggccgatcctttcctcgccgcgtttgcgtccgagaaggaccgacagactttggtggacgagttccatcacgtcgaggccgcgggcggcgaggtcgacttcgacctcctcgactacgacgcgattcattcgctcgagccttcactcggccagggtgtgaaagccggtttgcgtctgcgtaatcagcgtttcatcgatcccccattgttcgtgaactcgttggcggacgcggttcgtgaacgcggtggagaaatcgtcagcggtttcgacgtcacgcagatcgacgatcgggtcggcggagtcactgttcgcagtgcacacggtgattcacgcgacggcgacgccgtggtcatctcgagcggtgcccgcttgaacaagctctccgcaccgttcggtgtgcgcaaactggtgcaggccggacgcggatacagcttcagtgtcaagcccgagcacctccccaagaaccctgtgtatttccccacccagcgcgtcgcatgcactccgttgcacgatcgcttccgagtcgccggaatgatggaattccgcagccctgacgcgccgctggatccgcgccgcgtgcaggcgatcatcgatgcggccaagccgatgctcagcggcatcgactggactgcacgggaagaggaatgggtgggatcacgaccgtgcactaccgacggcttgccgttgatcggcgccacgaagtcgccgcgggtgcacgtcgccggtggtcacggaatgtggggaatcgccctgggtccgttgaccggaaagatggtggccgactcgatgaccggcgctcagacgccaaccgtcatgcgccacttcgatccgctgcgctga

SEQ ID NO: 590 - protein, 417 aa, Rhodococcus erythropolis DSMZ 44522
  DOMAIN (9)...(400): FAD dependent oxidoreductase
  SITE (119)...(122): N-glycosylation site. Prosite id = PS00001
  SITE (352)...(360): Myb DNA-binding domain repeat signature 1. Prosite id = PS00037
MGTRQSPDRVVVVGAGVVGLSTAWFLQERGVEVTVVDRDGVAADASWGNAGWLAPALTLPLPEPAVLQYGLRAMLSPSSPVYVPLTTDLKLIRFLVGFARHCTPSKWQEAMSVYTEVNRTALGAYDELADGGVKELTRLADPFLAAFASEKDRQTLVDEFHHVEAAGGEVDFDLLDYDAIHSLEPSLGQGVKAGLRLRNQRFIDPPLFVNSLADAVRERGGEIVSGFDVTQIDDRVGGVTVRSAHGDSRDGDAVVISSGARLNKLSAPFGVRKLVQAGRGYSFSVKPEHLPKNPVYFPTQRVACTPLHDRFRVAGMMEFRSPDAPLDPRRVQAIIDAAKPMLSGIDWTAREEEWVGSRPCTTDGLPLIGATKSPRVHVAGGHGMWGIALGPLTGKMVADSMTGAQTPTVMRHFDPLR

SEQ ID NO: 591 - DNA, 1245 bp, Unknown
  Obtained from environmental sample
atgcagtttgacgtcattgtcctcggcgccggaatcgtcggggtctcggtggcccttcacctcgcggaccgcggtcggtccgtcgccctcgtcgaccggcgcggtgccggcgaagagacatccttcggcaatgccggcctgatccagcgcgaaggggtggcgccgcatgcctttccccaggggctgggcgccttgctcacctatgcccgcaacgaccgcatcgacatgcactaccatctcgctgcgcttccgcgcattgcgccgcttctcgcgcaatactggtggcactcccgcaccgcgcgctaccgcgaggtcatgcgcacctatgcccccctcatcgcgcattcgatcagcgagcatgcgccgctgatcgcgcgtgccggggcagggcatctggtcgaaaagaagggctggtaccgcctctatcgcacggaagcgggattcgccgccgccgccgccgaggcgcgccgcctcttcgagaccttcggtgtcggctatgccgaactggatggcgacgagatgcgccggcgccagccgggcctggggctggcggtgcggggcgccgtgcagtggacggagccctggaacgtcagcgatccgggtggcctcgtctcggcctatctcgggctgttcgagcagcagggcgggcaattcgtccgcgccgacgcgctgcagcttgccccgcacggcgccggctggcgcatgccggtgcccggcggcaccatcgaggcgggcgaagtcgtggtggcgctcggcccctgggccggcgatctcgtttcgcgcctcggctatcgcctgccgctcggcgtcaagcgcggctaccacatgcactatgcccagcccgacgatgccccgctcgccaactgggtgctcgatgccgagcgcggctacatgctcaccccgatgcagcgtggcatccgcctgaccaccggcgcggaattcgccttgcgcgacgcccacgcaacgccggtgcaactggcccgggccgagaccgtggcgcgggagctgtttccgcttggcgcccgtctcgatgccgaaccctggcgcggcgcacgcccgatcacgcccgacatgatgccggtcatcggcgcggcgccgcgccatcgcgggctgtggttcgcctttggccatgcccatcacggcctgacccttggcccggttaccggccgcctgatcgccgagatgatcaccggcgccccgaccgtggtcgatcctgcacccttttcgccgcagcgcttcctgtga

SEQ ID NO: 592 - protein, 414 aa, Unknown
  Obtained from environmental sample
  DOMAIN (4)...(395): FAD dependent oxidoreductase
  SITE (199)...(202): N-glycosylation site. Prosite id = PS00001
MQFDVIVLGAGIVGVSVALHLADRGRSVALVDRRGAGEETSFGNAGLIQREGVAPHAFPQGLGALLTYARNDRIDMHYHLAALPRIAPLLAQYWWHSRTARYREVMRTYAPLIAHSISEHAPLIARAGAGHLVEKKGWYRLYRTEAGFAAAAAEARRLFETFGVGYAELDGDEMRRRQPGLGLAVRGAVQWTEPWNVSDPGGLVSAYLGLFEQQGGQFVRADALQLAPHGAGWRMPVPGGTIEAGEVVVALGPWAGDLVSRLGYRLPLGVKRGYHMHYAQPDDAPLANWVLDAERGYMLTPMQRGIRLTTGAEFALRDAHATPVQLARAETVARELFPLGARLDAEPWRGARPITPDMMPVIGAAPRHRGLWFAFGHAHHGLTLGPVTGRLIAEMITGAPTVVDPAPFSPQRFL

SEQ ID NO: 593 - DNA, 1272 bp, Unknown
  Obtained from environmental sample
atggcaccgcaatcggaaacggctttcatggcggaaacccacgacatcatcgttctcggcggcggcatcgtcggcgtttcgaccgcgctccatcttcagcggcgggggcgcagcgtcaccctcgtcgaccgccgcgagccgggcgaggagacgtccttcggcaatgccggcgtgatcgagggcgggacctacattccgatcgcgtttccgcacgatccggtcgagatcctgcgctatgcgaccaaccgccagtcggcgctgcatttccactggtcgttcctgccgcgcatcgcgccgtggctgtgggcgctctaccggaactcgacggaagacaagctcagggccaacggcagggcgatcatggcgctgaccgcagatgccatcggggagcacaaggcgctgctcgtcgaggcgaaggcggaggcgctgctgcgcatgaccggatggctgcgcgtctatcgcgacgaggcggagctcgccgccgacagcctcgagatgcggctcgccgacgaggagggcttcgcctacgacgtgctcgatgccgacgccgcgcgggagatcgagccgcatctggcgccggtgttcgccagggcggtgcactggcactcgatcgcctcggtgtcggatccgggggcggtgaccaaggccatcgccggactgttcgcggccgagggcgggcggatcgaacggggcgaggcgcggcggctcgtgcgggacggcgggcgctggcgggtggagaccgcagacggggcgctcgaagcgggcgaggtggtggtggcgctcgggccgtggtcgatggacctgctgcggccgctcggctgccgtctgcccttcgcggtcaagcgcggctaccattgccattacggcgcggtgggaaacgccgctctctcgcgtcccgtcgtcgacagccgctacggctatgcgctggcgccgatggcgaggggaatccggctcaccaccggaatcgaactggccggccgcgacgcgccgccgacccccgtccaggtcgatcgcgcagagcgccgcgcccgcgagctctttccgctggcggagccggtcgatgccgaaccgtggctcggccgccggccctgcttcccggattcgcgcccggtgatcgggccggctcccggccatcccgggctgtggctcaatttcggccacgcccatctcgggttctcgctggggccggtgagcgggcggctcgtcgcccagatgatgacgggagaggcgccgctcgccgatcccgcgctctttgcggcgacgcggttctga

SEQ ID NO: 594 - protein, 423 aa, Unknown
  Obtained from environmental sample
  DOMAIN (15)...(405): FAD dependent oxidoreductase
  SITE (108)...(111): N-glycosylation site. Prosite id = PS00001
MAPQSETAFMAETHDIIVLGGGIVGVSTALHLQRRGRSVTLVDRREPGEETSFGNAGVIEGGTYIPIAFPHDPVEILRYATNRQSALHFHWSFLPRIAPWLWALYRNSTEDKLRANGRAIMALTADAIGEHKALLVEAKAEALLRMTGWLRVYRDEAELAADSLEMRLADEEGFAYDVLDADAAREIEPHLAPVFARAVHWHSIASVSDPGAVTKAIAGLFAAEGGRIERGEARRLVRDGGRWRVETADGALEAGEVVVALGPWSMDLLRPLGCRLPFAVKRGYHCHYGAVGNAALSRPVVDSRYGYALAPMARGIRLTTGIELAGRDAPPTPVQVDRAERRARELFPLAEPVDAEPWLGRRPCFPDSRPVIGPAPGHPGLWLNFGHAHLGFSLGPVSGRLVAQMMTGEAPLADPALFAATRF

SEQ ID NO: 595 - DNA, 1257 bp, Unknown
  Obtained from environmental sample
atggcggaactcaaggccgacgttctcatcctgggcgccggcatggtcggcgtcggcgcggcattgcatctgcaacagcgcgggcgcgacgtcatcctcgtcgacaagcatgagctggcgggcgaggagacgagctacggcaatgcggggatcatcgaggccgcctcggtctttccctacatgtttcccagggagatcacggagatcctgcgttacgcgtcgaaccgtgcgccgcaggtgcgctatcatttcgccgatctgccgtccttcctgccgtggctgctccgttactatctggcctcgcggcccgatcgggcgctgcgcggcgcgatgggcgtgctgccgctgatccgccgcagcctcgtcgaacatgaggcgctgattgcggaagccggcgtgccggagctgttgcgcaagagcggctggatcaagctgtttcgctccgaggcgacaatgaagggagcgatcgccgaattcgagcgggccaggcaatatggcgtggaggccgacatcctcgatgcaggcgcgattgccgcgcgcgagccgaacctcagtggcgatttcgcgggagcacttcacttcacgcagcccggcttcgtgccggaccccggcggccttgccaaagcctacgccgcgctgttcaggcgcaagggcgggcgatttgtggtgggcgatgcccggacgttgcaacagcagcctgaccggcgctggcgcgtgacgacggcggaggggtcggcggtggcgcgcgaggcggtgatcgcgctcgggccatggtccgatctggtgttcggcccgctcggctattcgattccgctggcggtcaagcgcggctatcatctgcatctcgccccgcgcggcaatgccgtgctcaatcatcccgtgctcgatgccgaccagggcttcgtgctggcgccgatgaaccgcggcatccgcctgacctcgggcgtggagtttgcccgccgcgatgcgccggcaactcctcgccagatcgagcgtgcgctgccgaaggcgcgagggctgtttccgctcggcgaggcggtcgacgcccagccctggaagggcgcgcggccctgcttgccggacatgctgccggtgatcggccgggcgccgcgccaccagggcctgtggttcgacttcggccaccagcatcacgggctgacgctgggtcccgtgtccgggcgcctgctggcggagatgatgaccggggaggcgccgttcgccgacccggcgccgtttgccgccgagcgcttcggctaa

SEQ ID NO: 596 - protein, 418 aa, Unknown
  Obtained from environmental sample
  DOMAIN (7)...(399): FAD dependent oxidoreductase
  SITE (185)...(188): N-glycosylation site. Prosite id = PS00001
MAELKADVLILGAGMVGVGAALHLQQRGRDVILVDKHELAGEETSYGNAGIIEAASVFPYMFPREITEILRYASNRAPQVRYHFADLPSFLPWLLRYYLASRPDRALRGAMGVLPLIRRSLVEHEALIAEAGVPELLRKSGWIKLFRSEATMKGAIAEFERARQYGVEADILDAGAIAAREPNLSGDFAGALHFTQPGFVPDPGGLAKAYAALFRRKGGRFVVGDARTLQQQPDRRWRVTTAEGSAVAREAVIALGPWSDLVFGPLGYSIPLAVKRGYHLHLAPRGNAVLNHPVLDADQGFVLAPMNRGIRLTSGVEFARRDAPATPRQIERALPKARGLFPLGEAVDAQPWKGARPCLPDMLPVIGRAPRHQGLWFDFGHQHHGLTLGPVSGRLLAEMMTGEAPFADPAPFAAERFG

SEQ ID NO: 597 - DNA, 1317 bp, Unknown
  Obtained from environmental sample
atgaaggtactggtactgggcggtggcgtaatcggcgtatcgagcgcttatttcctggcgaaggctggctgcgacgtgacagtcatcgagcgtcagcccggcgtggcgttggagacgagttttgccaatgccggccagatctccccgggttatgctgcgccatgggctgcgcctggcatcccgaccaaggcggtcaagtggctgttccagaaacacgccccactggctatccgcccggatggcaccctgcaccagctcaagtggatggcgcagatgttcgccaactgcaatgaaaagcgctatcacgtcaacaaaggccgcatgatgcgcctggccgagtatagccgtgacgtgatccgcacgttgcgcgccgaaaccggcatcaaatatgaaggccgctcgcttggcacgctgcagattttccgttcacaggcgcaagtcgatggcgcggcgaaagacatcgccgtgctgcaggaatgcggtgtgccgtttgaagtgctcgaccgcgatggctgcgcacgagctgaaccagcgttggcccaggtgaagcacaagatcgccggcggcctgcgcttgcccaacgacgaaaccggtgattgccaactgtttaccatgcgcctggccgatatggcaaaggcacttggtgtgacctttcgtttcgacaccgaaatcgacgacatcctgttcgatggccgccgcatcaacggtgtgcggattggcgaagaaatcgtccgcgccgatcactacgtgatggcgctcggcagctactcgccgattattggccgcaaactagggctcgacttgccagtgtatccggtgaagggttattcgctgacaatcccggtcctcgacgaaacacgcaccccggtatcgaccatcctcgacgaaacctacaagatcgccctcacccgcttcgataaccgcatccgcgtcggcggcatggctgagctgtcgggttacgatctgcgcctgaacccgaaacgccgcgccacgctggaaatggtggtgaacgacttgttcccgggcggtggcgatgtaccggccgccagcttctggactggcctgcgcccgatgacacccgatggcaccccgctggtcggcgcaaccccgatcgccaacctgtcgctcaacaccggccacggcacgctgggctggacgatggcatgcggctccggcaagttgctcgccgatctgatcgccggtcgcaagccggaaatcagcgcagatggcttgtcgatggaccgctatcaaggccgtccggcagacaccggtggcgcgttacgtccggcaccggcattgcggagcaaccaagcgtga

SEQ ID NO: 598 - protein, 438 aa, Unknown
  Obtained from environmental sample
  SIGNAL (1)...(20)
  DOMAIN (2)...(398): FAD dependent oxidoreductase
  SITE (378)...(381): N-glycosylation site. Prosite id = PS00001
MKVLVLGGGVIGVSSAYFLAKAGCDVTVIERQPGVALETSFANAGQISPGYAAPWAAPGIPTKAVKWLFQKHAPLAIRPDGTLHQLKWMAQMFANCNEKRYHVNKGRMMRLAEYSRDVIRTLRAETGIKYEGRSLGTLQIFRSQAQVDGAAKDIAVLQECGVPFEVLDRDGCARAEPALAQVKHKIAGGLRLPNDETGDCQLFTMRLADMAKALGVTFRFDTEIDDILFDGRRINGVRIGEEIVRADHYVMALGSYSPIIGRKLGLDLPVYPVKGYSLTIPVLDETRTPVSTILDETYKIALTRFDNRIRVGGMAELSGYDLRLNPKRRATLEMVVNDLFPGGGDVPAASFWTGLRPMTPDGTPLVGATPIANLSLNTGHGTLGWTMACGSGKLLADLIAGRKPEISADGLSMDRYQGRPADTGGALRPAPALRSNQA

SEQ ID NO: 599 - DNA, 1251 bp, Unknown
  Obtained from environmental sample
atgaaagtcatcgttctcggagccggcgtcgtcggcgtaacgtccgcctatcaactggccaaggccggccatgacgtgacggtcatcgaccggcaggaaggcccggcactggaaaccagctttgccaatgccggcgaagtttccttcggctattgctcgccctgggcggcgcccggcattccggtcaaggccatgaaatggctgttcatggaacatgcgccgctgatcctgcgtccgaagatggatgcggcgatgctgtcctggatgctgaagatgctgatgaactgcactgcggagcgctatgcggtcaacaagagccgcatgctgcggcttgccgactatgcccgcgtctcgctggccgaggtccgctcggaaaccgggattgcctatgacgagcggatgcagggaacgctgcagctgttccgcaagcagcagcagctcgatgcatccgcatccgacgtcaaggcgctggcggcagacggcattccctatgaagtgctcgatccggaaggctgcattcgcgtcgagccggcgctcaagcatgtccgccacaagatcgtcggcggccttttgacgccaaaggacgagacgggcgattgcttcaagttcaccaatgcgctggcgctgaaggcagtggaactgggcgtaaaatttgtctggggcaccaatatcaaggcgctggatgtcgagggcgggcagatccgcggcgtggtcaccgacaagcagacgctgcgctctgacgccgtcgtcatcgcgctcggcagctattcgccgatgctggcaaagcaggtcggcatcaagctgccggtctatccggtcaagggctattcgctgacgatcccgatcaccgatgcatcgcgtgcgccggaatcgaccgtcatggacgagacctacaagatcgccatcacccgtctcggcgaccgtatccgcgtcggcggcatggcggaaatttctggctataccaacgatctcggtcccaagcgccgggcgacgctggagcattccgtcaccgatcttttccccggcggtgatgtgaaaaaggccgagttctggtcgggcctgcggccgatgacgccggacggcacgccggtgatcggtgccaccaaggtgaagggcctgttcctcaataccggccacggtacgctcggatggacgatgagctgcggctcggcaaaggtcatcagtgccatcgtcagcggcaagaagccggaaatcgacgccacggacctcgccgtctcccgctacgcctga

SEQ ID NO: 600 - protein, 416 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
  SITE (105)...(108): N-glycosylation site. Prosite id = PS00001
MKVIVLGAGVVGVTSAYQLAKAGHDVTVIDRQEGPALETSFANAGEVSFGYCSPWAAPGIPVKAMKWLFMEHAPLILRPKMDAAMLSWMLKMLMNCTAERYAVNKSRMLRLADYARVSLAEVRSETGIAYDERMQGTLQLFRKQQQLDASASDVKALAADGIPYEVLDPEGCIRVEPALKHVRHKIVGGLLTPKDETGDCFKFTNALALKAVELGVKFVWGTNIKALDVEGGQIRGVVTDKQTLRSDAVVIALGSYSPMLAKQVGIKLPVYPVKGYSLTIPITDASRAPESTVMDETYKIAITRLGDRIRVGGMAEISGYTNDLGPKRRATLEHSVTDLFPGGDVKKAEFWSGLRPMTPDGTPVIGATKVKGLFLNTGHGTLGWTMSCGSAKVISAIVSGKKPEIDATDLAVSRYA

SEQ ID NO: 601 - DNA, 1254 bp, Unknown
  Obtained from environmental sample
atgaagatcaccattctcggcgcaggcgtcatcggcgtcacatccgcctattatctcgccaaggccggccacgaggtgaccgtcgtcgatcgccagccgggcccggcgctggaaacgagttttgccaatgccggcgaggtttccttcggttactgctcgccctgggctgcgcctggcattccgcagaaggcgctaaagtggatcttcatggagcacgcgccgctgatcctgaggccgaagctcgatggtccgatgctctcctggatgctgaaaatgctgatgaactgcacctcggagcgctatgccatcaacaagagtcgtatgctgcggcttgccgattacagccgcctcgcgctcgccgaggtgcgcgccgaaaccaatgtggactacgaccagcgcatgcagggaacgctgcagctcttccggaccgaagcccaactcgaagcctctgccaaggacgtgaaggcgctcgccgccgatggtattcctttcgaagtgctcgatccggaaggctgcatccgcgtcgagcccgcactcgcccatgtccgccacaagatcgtcggcggcctcctcacccccaaggatgaaaccggcgactgcttcaagttcaccaatatccttgcagaaaaggccaccggcatgggtgtccgtttcgaatggggcgtcaacatcaaggggctcgacgtccagggcggcgaagcgaagggcgtcgtgaccgatcgcggcacgatcgcgtcggatgccgtggtcgtggcactcggcagctattcaccgctccttgtcaagccgcacggcatcaacctgccggtctatccggtgaagggctactcgctgacgatcccgatcaccgatgcctcgcgcgcgccggaatcgactgtcatggacgaaacctacaagatcgcgatcacccgtctcggcgaccgtatccgcgtcggcggcatggcggaaatctccggctacaccaatgatcttggcgaagcgcgccgccggacgctggaacattccgtcaccgaccttttcccgggcggcgatgtctcgaaggccaatttctggtcgggccttcgcccgatgacgccggacgggacgccggtgatcggcgccaccaaggtccgcaacctctatctcaacaccggccacggcacgcttggctggaccatgagctgcggttcggccaaggtgctggccgatatcgtcagcggcagacaagccgatatcgagacgaaggatctggcgatcagccgttacgcggcctga

SEQ ID NO: 602 - protein, 417 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
  SITE (105)...(108): N-glycosylation site. Prosite id = PS00001
MKITILGAGVIGVTSAYYLAKAGHEVTVVDRQPGPALETSFANAGEVSFGYCSPWAAPGIPQKALKWIFMEHAPLILRPKLDGPMLSWMLKMLMNCTSERYAINKSRMLRLADYSRLALAEVRAETNVDYDQRMQGTLQLFRTEAQLEASAKDVKALAADGIPFEVLDPEGCIRVEPALAHVRHKIVGGLLTPKDETGDCFKFTNILAEKATGMGVRFEWGVNIKGLDVQGGEAKGVVTDRGTIASDAVVVALGSYSPLLVKPHGINLPVYPVKGYSLTIPITDASRAPESTVMDETYKIAITRLGDRIRVGGMAEISGYTNDLGEARRRTLEHSVTDLFPGGDVSKANFWSGLRPMTPDGTPVIGATKVRNLYLNTGHGTLGWTMSCGSAKVLADIVSGRQADIETKDLAISRYAA

SEQ ID NO: 603 - DNA, 1254 bp, Unknown
  Obtained from environmental sample
atgaaaagagtaattgtaattggaagtggcgctttgggactatgcagcgcttattttcttcaaaaagaaggatgtagagtacaggtgatcagcgcctcaaaaaaaggcgaagcagaaggctgttcatatggaaatgcgggaatgatcgtgccaagtcatctaagccctttagcggctccgggtgtaatacgaaaagggctaaaatggttactggatcctcaaagtccactatatattaaacctcgtttaaatgctgatctgatgtcatggttatggcattttataaaatcgtcgaatgaaaaaaatgttcagcaagccggacctttattattagagatgaacctggcaagtcgcgatctttttaaatctatttcagaaagtgaagcactaaattatcagtatcagcgaggtggtttaatgatgctatacaaaacaagtgcttttcaggatgaagaagagcatctggccgaaatagggagggaatatggattggaaatagacgtcttgaattcggctcagctccgaaatcatgaggaaaagctggaagcggatgttttgggtggggtgtggtataaaagcgacgcccacattattccccaaagttttatggaagaaatgactgacttactttttaaaagaggagttcagttcgaatatgataaaagaatcgattccattgtgaaagaaaatggaagaataaaagccatcagatcgcttgaagaagaatttgaagcagatgaatatattatttgttcgggaagctggagtcaggaaatggtaaaggcacttcaaatcaatcttcctattcaggctggaaaaggctaccatcttcatattccatcagttcccctgcaacttaaaacgccttccatattgtgcgaagcgaaagtagcgatgacgccgatgttgaatgatcttcgaatttccggaacgatggaatttgccggtttggatctgaagatcaataataatagggtagaggggataaaaaacagcgtcggcaagtatttcaaaaaatttgataagaatttatttaatggcataagtccctgggcaggattaagacctgtatctcctgatggcctgccttatatgggaagaagtgaaagcatttctaatctcagttttaatacaggacatgccatgatgggcttaagtttagctccaatcagcggaaaattgatcagtgacttgatcaccaaaggaacatgcgaaatgaatatcgatatcttatctccggatcgatttaagtaa

SEQ ID NO: 604 - protein, 417 aa, Unknown
  Obtained from environmental sample
  DOMAIN (3)...(398): FAD dependent oxidoreductase
  SITE (378)...(381): N-glycosylation site. Prosite id = PS00001
MKRVIVIGSGALGLCSAYFLQKEGCRVQVISASKKGEAEGCSYGNAGMIVPSHLSPLAAPGVIRKGLKWLLDPQSPLYIKPRLNADLMSWLWHFIKSSNEKNVQQAGPLLLEMNLASRDLFKSISESEALNYQYQRGGLMMLYKTSAFQDEEEHLAEIGREYGLEIDVLNSAQLRNHEEKLEADVLGGVWYKSDAHIIPQSFMEEMTDLLFKRGVQFEYDKRIDSIVKENGRIKAIRSLEEEFEADEYIICSGSWSQEMVKALQINLPIQAGKGYHLHIPSVPLQLKTPSILCEAKVAMTPMLNDLRISGTMEFAGLDLKINNNRVEGIKNSVGKYFKKFDKNLFNGISPWAGLRPVSPDGLPYMGRSESISNLSFNTGHAMMGLSLAPISGKLISDLITKGTCEMNIDILSPDRFK

SEQ ID NO: 605 - DNA, 1254 bp, Unknown
  Obtained from environmental sample
atgtcagcagatgtgatcgtcctcggcgccggtatcatcggtgtctccacagccatccatctggcccggcgcggcaagagtgtggttctggtcgacagacggggcgccggcgaggaaacatcgttcggcaatgccggtctgatccagcgcgaaggcgtcgtgccctacggctttccccagcagctgcggctgatcgcccgctatgcgctcaacaacaatatcgatgcccattaccactggtcggccatgccgaagctcgcctcgttcctggcgcaatactggtggcattccaacaccaagcgccaccaggcgatcgccagggcctacgcgccgctgatcgagaattccatttccgagcatgacgacctgatcaaggcgtccggcgccggaaatctgatttcgaaaaggggctggctcgaggttttccgcacctctgccgtgcgcgacgcagaatatgccgaagccgaacggctcagccgcgaatgcggcatccatttcaccgcgctgtcggccaacgacgtcggccaggcggagccgcacctcaccggcgatttttccggcgggctgaaatgggaagatccatggtcggtgttcgacccgcacgggctgacgatcgcctatcttcgcctgtttgagagcctcggcggccgtttcgtcaagggcgacgccaccaggatcgcccagcgatccaccggcaagggctggcagatcgacacggccgagggcaagatcgaagccgccgaagtcgtggtcgcgctcggcccctggtccgacatggtcaccaagcctctcggctatcgcttcccgctcggcgtcaagcgcggctatcacatgcattacggcacagacgagggtgtgcggctcaacaactggaccatggacaaggagcgcggctatttcctggcgccgatggtcaacggcatccggctcaccaccggcgccgaattcgcgtcccgcgacgcgccgaagacgccggtgcaggttgaccgggccgaaaaggtcgcccgcaagatcttcccgctcggtgaacggctcgacgccgaaccgtggatggggtcccgcccctgcacgcccgacatgatgccgatcatcggccgggcaccgcgccacgacggcctgtggttcgccttcggccacgcccatcacggcttgacgctcgggccggtcaccggacgcatcctcgccgaggccatgaccggcgaaaagaccttcatcgatgccacgccttaccggccggagcgcttccggccgtaa

SEQ ID NO: 606 - protein, 417 aa, Unknown
  Obtained from environmental sample
  DOMAIN (4)...(397): FAD dependent oxidoreductase
  SITE (294)...(297): N-glycosylation site. Prosite id = PS00001
MSADVIVLGAGIIGVSTAIHLARRGKSVVLVDRRGAGEETSFGNAGLIQREGVVPYGFPQQLRLIARYALNNNIDAHYHWSAMPKLASFLAQYWWHSNTKRHQAIARAYAPLIENSISEHDDLIKASGAGNLISKRGWLEVFRTSAVRDAEYAEAERLSRECGIHFTALSANDVGQAEPHLTGDFSGGLKWEDPWSVFDPHGLTIAYLRLFESLGGRFVKGDATRIAQRSTGKGWQIDTAEGKIEAAEVVVALGPWSDMVTKPLGYRFPLGVKRGYHMHYGTDEGVRLNNWTMDKERGYFLAPMVNGIRLTTGAEFASRDAPKTPVQVDRAEKVARKIFPLGERLDAEPWMGSRPCTPDMMPIIGRAPRHDGLWFAFGHAHHGLTLGPVTGRILAEAMTGEKTFIDATPYRPERFRP

SEQ ID NO: 607 - DNA, 1251 bp, Unknown
  Obtained from environmental sample
atgaaagtcctggttcttggagccggtgtggtgggcgtgaccagcgcctggtatctcgcggaagacggccacgaggtgacggtcgtcgaccgccagcccggcgccgggctggagacgagcttcgcgaacggcggccaggtctcggtgagccaggccgagccgtggtccaaccccggcgcgccggcgaagatcctcaagtggctgggcgacgaggaggcgccgctgctgttccggccgacggcgagcgcacggcagtgggcgtggggcgcgcgcttcttctacgagtgcctgcctggacgcacgcgcgagaacaccctgcagatcctgcgcctcgcgatctacagcggggcacagctcaagctgctgcgcgagcggaccggcatccgctacgacgggctgcagcgtggtctgctgcagatcaactactcggcgcaggacttcgagcacgccaaggcgcgcgcggcgctgctcggcagccacgggctggggctgcaggtgctgaacgcgcaggagtgcctggcgctcgagccagcgcttggctacagcaaggtcaagccggtcggcgggacctacgcgccgtccgacgagtccggcgacgcgcatctgttcacccacaacctcgcgcagctctgcgtgcagcgcggagtgcagatgcgctatgacgtcacggtcgagcggctggaagcacgcgacggcaaagtcacgggcgcagtcgcacgcctggcgggcggcgctcccgagctcatgcaggccgacgccgtgctcgtctgcctgggcacctggaccccgtttctcctcgagccgctcggggtgcgggcgccgatctatcccgtcaagggctactcgatcaccgtccccgtcgtgcgtccggagcaggcgccgagcgtgtgcctgaccgacgaggggcacaagctcgccatctcccggctcggcgaccggctgcgggtggccgggacggccgagctcaacggctacgacaccacgatcagcgagcggcgctgcaacgcactgatcgaacgcgccaaggtgctcttccccgacgcggtggacttcacgcgtgcacagcgatgggccgggctgcggccggcgacgcccggcaatgtccccgtgatcggcggcacgcgctggcccaacctcttcgtcaacgccgggcacggtacgctcggatggacgctgtgcgccggctcgggccgggcgatcgcggacatcgtcggcgggcgccggccgcaggtggatttccgcttccgctag

SEQ ID NO: 608 - protein, 416 aa, Unknown
  Obtained from environmental sample
  DOMAIN (2)...(403): FAD dependent oxidoreductase
  SITE (143)...(146): N-glycosylation site. Prosite id = PS00001
MKVLVLGAGVVGVTSAWYLAEDGHEVTVVDRQPGAGLETSFANGGQVSVSQAEPWSNPGAPAKILKWLGDEEAPLLFRPTASARQWAWGARFFYECLPGRTRENTLQILRLAIYSGAQLKLLRERTGIRYDGLQRGLLQINYSAQDFEHAKARAALLGSHGLGLQVLNAQECLALEPALGYSKVKPVGGTYAPSDESGDAHLFTHNLAQLCVQRGVQMRYDVTVERLEARDGKVTGAVARLAGGAPELMQADAVLVCLGTWTPFLLEPLGVRAPIYPVKGYSITVPVVRPEQAPSVCLTDEGHKLAISRLGDRLRVAGTAELNGYDTTISERRCNALIERAKVLFPDAVDFTRAQRWAGLRPATPGNVPVIGGTRWPNLFVNAGHGTLGWTLCAGSGRAIADIVGGRRPQVDFRFR

SEQ ID NO: 609 - DNA, 1233 bp, Unknown
  Obtained from environmental sample
gtgaaagtcgatgcggtcgtcctcggcgccggaatggtgggcatcccggtcgcgctgcacctgcaggcgcgcgggcgctcggtggtgctcgtggaccggcgcggcgcggccgaggagacgtccttcggcaatgcgggcctcatccagcgcgagggcgtgtacccctacggtttcccgcacgacttcggcgcgctgctgcgctacggcttcaaccggacgatcgacgcgcactaccaccccacggcgctgttcgacctcgcgcccttcctctggaagtactggcatcactcgcgcccggcgcgccacgccgagatcgcgcgcctctacgcgaagctgatcgagcgctgcgtggcggagcacgacgcgctcgcgcagcaggcgggcgcaacggacctcctgcggcgcaagggctggatgcgcgtatttcgcaccgagcgcgaacgggacgtgcgcatcgcggaagcgaagaaatggcgggcggagtttggcattgcttttgaatctctcgataaaaaagcactgcgggacaaggaaccccacctggccccggtcctcgtgggcgcgctgcactggaccgacccggtgagcgtcatcgatccgcagggtcttgcgctcgcgtacctgaagctgttcgaaagccggggcgggcgattcctgcagggcaatgccctctcgctggagcaaggctggaaagtccagacggttgaaggcacggtcgaggcaggcacggtcgtcgtctgtctcggtccctgggccgacctcgtgacgaaaaagctcggctacgacctgccgctcgccgtgaagcgcggctaccacatgcattaccgcgccgcaggcaaggcgatgctcaaccaccccatcctcgacaccgagcgcggctacctgatcgcgccgatgaagcgcggtatccggctcaccacgggcgcggagttcgcgctgcgcgacgcgatccgcacgccggtgcagctcgggcgcgccgagcccatcgcccgcgacctgttcccgctcgccgagcgcctcgacaccgaggcctggatgggcgcgcggccctgcaccccggacatgatgcccatcatcggtcctgcgccgcggcacaaggatctctggttcgcgttcggccacgcgcaccacggcctcacgctcggtcccgtgacaggtcgcctcatcggagagatggtcgccggcgagacgccgttcaccgatccggcgccctaccgcgcggatcgcttctga

SEQ ID NO: 610 - protein, 410 aa, Unknown
  Obtained from environmental sample
  DOMAIN (4)...(392): FAD dependent oxidoreductase
  SITE (72)...(75): N-glycosylation site. Prosite id = PS00001
MKVDAVVLGAGMVGIPVALHLQARGRSVVLVDRRGAAEETSFGNAGLIQREGVYPYGFPHDFGALLRYGFNRTIDAHYHPTALFDLAPFLWKYWHHSRPARHAEIARLYAKLIERCVAEHDALAQQAGATDLLRRKGWMRVFRTERERDVRIAEAKKWRAEFGIAFESLDKKALRDKEPHLAPVLVGALHWTDPVSVIDPQGLALAYLKLFESRGGRFLQGNALSLEQGWKVQTVEGTVEAGTVVVCLGPWADLVTKKLGYDLPLAVKRGYHMHYRAAGKAMLNHPILDTERGYLIAPMKRGIRLTTGAEFALRDAIRTPVQLGRAEPIARDLFPLAERLDTEAWMGARPCTPDMMPIIGPAPRHKDLWFAFGHAHHGLTLGPVTGRLIGEMVAGETPFTDPAPYRADRF

SEQ ID NO: 611 - DNA, 1254 bp, Unknown; identical to SEQ ID NO: 579
  Obtained from environmental sample

SEQ ID NO: 612 - protein, 417 aa, Unknown; identical to SEQ ID NO: 580
  Obtained from environmental sample
  SIGNAL (1)...(20)
  DOMAIN (2)...(397): FAD dependent oxidoreductase
  SITE (96)...(99): N-glycosylation site. Prosite id = PS00001
  SITE (105)...(108): N-glycosylation site. Prosite id = PS00001

SEQ ID NO: 613 - DNA, 1287 bp, Unknown
  Obtained from environmental sample
atgaagatcaccatcatcggagcaggcattgctggcgtcagtaccgcctgggcactgacgcaggccgggcacgaggttagagtggtcgagcgcaaaggtgccgctgccatggaaacgagttatgccaatgcgggtcaattggcctacggtgccatagcaccctgggcgtcgatgtcgatgattcgctccagcctgaaaaccttgctgaagcctgccggtgcgttaaaacttcccctgttcccatccctgttgacctggcatttcatgatcaccatgggccgctttgcgctgaaaaagcgattgtttgaaaccaattggcaggccatgttggacctggggcaattcagtaaagaggccttgcgtgagctggaatcggaactctctctgaagtacgacggccatcataacggaatgttgaaactggctagcacggcagcagaaaagcaggaactgatgggcgtcgccgccatgctggcgcgttgcgagatccgccatcaatggctctctgctcaggaggcgatggatacagagcccggcctgaatgccgaagcgcccttgctgggtgggttgcacttgcctggcgatggcagtggcgattgccatcgtttcagcgttgaattggccagggcctgtgagcaggctggtgtggtctttgattacgacagtgaagtgctcagcctgcgtaccagtacggacagtctggaggccatttatgtgcggcagcacggtaaggaagactggctggagtcggatgcctttgtgttctgcacgggctgtgcgagtcgggagttcggcttatcactcggcttgaagttgcccatttatccggtcaaggggtattcgattaccttgccagttaccgcacctgagcgggcaccggtctcggctgtcatagacgatcgttaccgcctggccatcacccgccttggcaagcgagtgcgtgtgacaggctttgccgagctggtcgataacgataaaactttgccagacaagcggttgtctgtactgcgcgagggtttcgatttccgctttccgggctcggtggattggtcggaagccgaaccctgggcgggcttccgacccatgacgccggacggcccgccagccattggccagggcatgcaggacaatgtctggttcaataccggacacggcacctggggctggaccatggcggccggtagcgccgctctactcagtcagcaaattgccggttcaccaccagacttcaacaccagacccttcgatccgactcgcttttctcggaaggggtggttcaagggctga

SEQ ID NO: 614 - protein, 428 aa, Unknown
  Obtained from environmental sample
  SIGNAL (1)...(18)
  DOMAIN (2)...(402): FAD dependent oxidoreductase
MKITIIGAGIAGVSTAWALTQAGHEVRVVERKGAAAMETSYANAGQLAYGAIAPWASMSMIRSSLKTLLKPAGALKLPLFPSLLTWHFMITMGRFALKKRLFETNWQAMLDLGQFSKEALRELESELSLKYDGHHNGMLKLASTAAEKQELMGVAAMLARCEIRHQWLSAQEAMDTEPGLNAEAPLLGGLHLPGDGSGDCHRFSVELARACEQAGVVFDYDSEVLSLRTSTDSLEAIYVRQHGKEDWLESDAFVFCTGCASREFGLSLGLKLPIYPVKGYSITLPVTAPERAPVSAVIDDRYRLAITRLGKRVRVTGFAELVDNDKTLPDKRLSVLREGFDFRFPGSVDWSEAEPWAGFRPMTPDGPPAIGQGMQDNVWFNTGHGTWGWTMAAGSAALLSQQIAGSPPDFNTRPFDPTRFSRKGWFKG

SEQ ID NO: 615 - DNA, 1248 bp, Unknown
  Obtained from environmental sample
atgacaaaggacgcaatcgttctcggcgcaggcatcgtcggtgtttcgacggcaatccatctgcagcggcggggacggcaagtcgtcctcgtcgatcggcagccaccgggccgtgggacctcgttcggcaatgccggcctcatccagcgcgagggcgtggtgccctatggctttcctcagcaattcggcctgctgctgcgctatgccttcaacaaccgcatcgacgcacattaccatctgcgcgccctgccggcgcagatcgcctttcttgcccgctattggtggaactccaataccaagcgccatgagatgatttcgcgtgcctatgcgccgctgatcgaacattccgtcagcgagcacaatgacctcatcgaagcctcgcacgccgaggagctcattcgcaagaacggctggatggagctgttccgctcgaacgagaagcgggatgccgagtttgccgaggcggagcgcctcaaccgcgaattcggcatcggctatgacgcgctgagcagcgcagatatcgcaagtgccgagccgcatctgagaggcagctttgctggagcacttcgctggcgcgatccctggtcggtgctggacccgcacggattgacggcggcctatcggcgatatttcgaaagcattggcggccgtgtgacgaccggggatgccgtctcgctcggcatggcaggttcggcgtggagaatggtgacggcggagggatcgatcgaggcggaggatgtcgtcgtcgcactcggcccgtgggctgatatcgtcacgaaacgcttcggctacgctttcccgctcggcgtcaagcgcggctaccacatgcattacgccgccgagggcaatgccgttctcaacaactggatgctggatgccgagcgcggctatctgctggcgccgatgagccgtggcattcgtctgacgaccggcgccgaattcgccctgcgcgatgcaccgaagacgccggtgcagctcgatcgcgcagaggccatcgcccgcgccgccttcccgctcggcgaacggctcgatccggaaccctggatgggtgcgcggccctgcacgcctgacatgatgccgattatcggcaaggcgccgcgccacaacggcctatggttcgccttcggccatgcccatcatggattgacgctcggcccggtgaccggccgcgtgcttgcagagctcatcaccggcgagacgccgttcatcgatatttcggcttatgctcctagcaggtttgcgccctaa

SEQ ID NO: 616 - protein, 415 aa, Unknown
  Obtained from environmental sample
  DOMAIN (4)...(395): FAD dependent oxidoreductase
MTKDAIVLGAGIVGVSTAIHLQRRGRQVVLVDRQPPGRGTSFGNAGLIQREGVVPYGFPQQFGLLLRYAFNNRIDAHYHLRALPAQIAFLARYWWNSNTKRHEMISRAYAPLIEHSVSEHNDLIEASHAEELIRKNGWMELFRSNEKRDAEFAEAERLNREFGIGYDALSSADIASAEPHLRGSFAGALRWRDPWSVLDPHGLTAAYRRYFESIGGRVTTGDAVSLGMAGSAWRMVTAEGSIEAEDVVVALGPWADIVTKRFGYAFPLGVKRGYHMHYAAEGNAVLNNWMLDAERGYLLAPMSRGIRLTTGAEFALRDAPKTPVQLDRAEAIARAAFPLGERLDPEPWMGARPCTPDMMPIIGKAPRHNGLWFAFGHAHHGLTLGPVTGRVLAELITGETPFIDISAYAPSRFAP

SEQ ID NO: 617 - DNA, 1245 bp, Unknown
  Obtained from environmental sample
atggcacgcactgacgtaatcgttctcggcgccggtattgtcggcacttcgatcgcgctgcaactcgtcaagcgcaatatgagcgtcgcgctggtggagcgcgcgggcctcggcgagcagacgtcctacggcaattcgggcgtgatcgaaggctcgaccatcatgccgccggcctttccgagcgatatcggcgcggtgctgcgagtggcgctcaagcaggcgagcgacgccaactatcatcttagcttcttgccctgggcagcgccgtggctgctagcgttccgcgcggcctcgcagcccaaaaccatcgagcagaccgcgcgcatcaaccggcccctgttcgcccgcgctgtggccgagcacgaagagctgatgctcgaatccggcgccacccagcttctgcgccgcgacggctggatcaaactctatcgcaccgatgcggcctttgccggcatcgccaaggatctcgaactcgcgcgggaattcggcgtgccgttcaagacactcgatcccgaaggcgcgcgcaatcttgaaccgtcgctgtttccggtattcaagcacgcagtgcattggccggcgtcgccgaccttgagcgatccgctggccctgacgaaggcctatgccgcgcgcttcggcaccttgggcggcataacgctcaatggcgacgccttcacgctgcatcgttcgggcagcaattggcgcgtcgaaaccgacgaagggccgatcgacgcagctcaagtcgtggtcgcgctcggtccgtgggcgatggatttgctgaagccgctcggcatcaagctgccgatgggtttcaagcgcggctatcaccgtcacttcaagaccgaggaaagcgcgccgctgtcgcggccggtggtcgatgtgcaatacggctatctgatcacgccgatgcggcagggcatccgcgtcacgaccggcgcggaattcgccgaccgcgatgcggctccgacgccggtgcagttcgatcgcttcatgccgaagctgaacgagctctacaaaatcggaccgcgcgccgaggatcgtacctggctcggctcgcgaccttcatttccggattcccggcccgtcatcggacgcgcgcctgggcaaaagggaatgtggctcgccatcggccacgcgcattgggggctcacgctgggtccggtcaccggacgtctgctcggcgagatgatggcgggggaaacgccgtttctcgatcccaagggcttcgccgccgaacgcttcatgtaa

SEQ ID NO: 618 - protein, 414 aa, Unknown
  Obtained from environmental sample
  DOMAIN (5)...(395): FAD dependent oxidoreductase
  SITE (26)...(29): N-glycosylation site. Prosite id = PS00001
MARTDVIVLGAGIVGTSIALQLVKRNMSVALVERAGLGEQTSYGNSGVIEGSTIMPPAFPSDIGAVLRVALKQASDANYHLSFLPWAAPWLLAFRAASQPKTIEQTARINRPLFARAVAEHEELMLESGATQLLRRDGWIKLYRTDAAFAGIAKDLELAREFGVPFKTLDPEGARNLEPSLFPVFKHAVHWPASPTLSDPLALTKAYAARFGTLGGITLNGDAFTLHRSGSNWRVETDEGPIDAAQVVVALGPWAMDLLKPLGIKLPMGFKRGYHRHFKTEESAPLSRPVVDVQYGYLITPMRQGIRVTTGAEFADRDAAPTPVQFDRFMPKLNELYKIGPRAEDRTWLGSRPSFPDSRPVIGRAPGQKGMWLAIGHAHWGLTLGPVTGRLLGEMMAGETPFLDPKGFAAERFM

SEQ ID NO: 619 - DNA, 1593 bp, Unknown
  Obtained from environmental sample
atgaaaccagacggcggttccctgattggcttcggttccagcggcacgggcggcgcttccttcaaggcgttcgatccggccaagaacacggcgttggagccgtcgtttctctcggcgacgtccgccgacgtcgaccgcgcggtcgaactcgccgtcgccgccgcgccggtgctcgcccggctttccggcgcgggccgcgcgaagttcatgcgcgccatcgccgccaacctcgaggccaaggccgacgatctcgtcgcccgcgccatgcaggaagccgcgctgcccgaagcccgcctgaagggcgaggtggcgcgcaccgtcggccagctgcgcctgtatggcgaagcggcggagaaggggacttggatcgatgcgcgcatcgagacggcgcagcccgaccgcaagccgctgccgaaacccgatcatcgttcgctcctgcgtccgctcggcccggtggtcgtgttcggttccagtaatttcccgttcgcttactccgtcgcgggcggcgacaccgcttccgccttcgccgccggctgcccggtgatcgtcaaggcgcacccggcgcatccgggtacgagcgaaatgactggacgcctgatcctgcacgcggtgcgcgattgcggcctgcccgagggcacgttctcactcctgttcgatggtggcttcgaaatcggtcaggcgctcgtgaagcatccggcgatcaaggccgcgggcttcaccggctcggtcaagggcggtcgcgcgctcaccgatctcggtgccgcgcgtccggaaccgattccggtttacgccgaaatgggcagcgtgaaccccgtgttcatcctgcccggcgcgctggcggaacgttccgcggccatcgtcgacggcctgcatgcttccggcacgctcggcgtcggccaattctgcaccaatccgggcttgatcgtcctgcagcgctcgccggccgccgaggaattcgtgaaggcgctggtcgccaagctcaatgtcacgcccgaaggcatcatgctgacgcccggcatcgccaaggcctacgccaccaacaccgcccagcgcgcgaagcagccgggcgtgaagttgctcgcgcaggcgccggcgcaggccgcgtgcggcgtggcgccgatctggttcgaaaccgacgccctgagcttcctcggcaatcatttgctggccgaggaaatcttcggcccgagtgcgttggtcgtctggtgcaaggatcgcgccgagatgctccaagttgcggccaatgtggaaggttcgcttaccgcgacgctgcaagtcggcgcggcggaggcgaaggaccagaccgatctcatcgaattgctcgccaccaaggccgggcgcctcgtgctcaacggctatccgaccggcgtcgaagtcagccacgcgatcgtgcacggcgggccgtatccctcgacgagcgacggcggccgcaccacctcggtcggcacccgcgcgatcggccgttgggcgcgtccgatctgctaccagagcttcctcgacgagttgctgccggcggaattgcagaatgcgaatccgttgaagctcacccggctcgtgaacggcctcgccaccgaccaggcgatttcatcgtaa

SEQ ID NO: 620 - protein, 530 aa, Unknown
  Obtained from environmental sample
  DOMAIN (11)...(481): Aldehyde dehydrogenase family
MKPDGGSLIGFGSSGTGGASFKAFDPAKNTALEPSFLSATSADVDRAVELAVAAAPVLARLSGAGRAKFMRAIAANLEAKADDLVARAMQEAALPEARLKGEVARTVGQLRLYGEAAEKGTWIDARIETAQPDRKPLPKPDHRSLLRPLGPVVVFGSSNFPFAYSVAGGDTASAFAAGCPVIVKAHPAHPGTSEMTGRLILHAVRDCGLPEGTFSLLFDGGFEIGQALVKHPAIKAAGFTGSVKGGRALTDLGAARPEPIPVYAEMGSVNPVFILPGALAERSAAIVDGLHASGTLGVGQFCTNPGLIVLQRSPAAEEFVKALVAKLNVTPEGIMLTPGIAKAYATNTAQRAKQPGVKLLAQAPAQAACGVAPIWFETDALSFLGNHLLAEEIFGPSALVVWCKDRAEMLQVAANVEGSLTATLQVGAAEAKDQTDLIELLATKAGRLVLNGYPTGVEVSHAIVHGGPYPSTSDGGRTTSVGTRAIGRWARPICYQSFLDELLPAELQNANPLKLTRLVNGLATDQAISS

SEQ ID NO: 621 - DNA, 1266 bp, Unknown
  Obtained from environmental sample
atgagaacctccaagtccgtcatcgtctgcggcggcggcatcgtcggcctttgcactgcgtattatctcgcgcgcgaaggctgcgaagtgaccgtcgtcgagcgccacgccgagaacgcgcacgaccattgcgcgctgggctccgccggctacgtctcgccgagccacgtcatcccgctggccgcgcccggcatggtctggaagggcctcaagtggatgacgaactcgcgcagcccgttctacatccagccccggctcgactccgatctgatgcgctggggctggcatttctggcgcgcgagcagccagcgtcgcgtcgagcgtgccgccccgatcctgcgcgacctgtgcctgatggcgcgccagctttacgaggaactcgacgatctcaccggcgaccgttccgacttccggaaggacggcctgctcaatctttgccagaccgaggcgggcttcgagcacgaggtgcacggtctggccaagctggcgaacgagctcggcgtcgaagcgcaagtgctggacgcgcagcagaccgccgcgctcggtttgggggtgaaggtcaacatcatcggttcggttttctttccgatcgatgcgcacctgacgccggcgcgcttttgtccggcgctgaccgcgctgctcaaggagatgggcgtgcgcttccgtttcagcacgacgatctacggctggcgcacggaagggcggcggctggcggcggtgcagacgacggccggcgatttgatcgccgacgaatttgtcctaaccggcggctcgtggtcgccgggcatgatctccgcgctcggcgcgcgtctgccgatgcaggcgggcaagggctacagcctcacggtgcagcggccgcgcctgcgcgcgaccaagccgatgatcctcgtcgaacgccgcgtggcgctgacgccgatgggcgagacgatgcgttttggcggcacgatggagattgcgggccacaacgatcgcatgcgcccggagcgactggaacagatcaaggccggcgcgatggcgttcctgccggagctgacgcccgatgacttcgccgaggcacggccgtggtttggctatcgtccggtgacgccggacgggttgccatacatcgggcgctttgggcgctggaccaatcttaccgccgcgtgcggccacgcgatgctgggcgtcacgctcgccccgaccaccggccgcctcgtggctgaggtgatcggtggcaagaagccgtcagtgaatctgacactgctcgatccgaatcggtacgcgtag

SEQ ID NO: 622 - protein, 421 aa, Unknown
  Obtained from environmental sample
  SIGNAL (1)...(24)
  DOMAIN (6)...(402): FAD dependent oxidoreductase
  SITE (382)...(385): N-glycosylation site. Prosite id = PS00001
  SITE (417)...(420): N-glycosylation site. Prosite id = PS00001
MRTSKSVIVCGGGIVGLCTAYYLAREGCEVTVVERHAENAHDHCALGSAGYVSPSHVIPLAAPGMVWKGLKWMTNSRSPFYIQPRLDSDLMRWGWHFWRASSQRRVERAAPILRDLCLMARQLYEELDDLTGDRSDFRKDGLLNLCQTEAGFEHEVHGLAKLANELGVEAQVLDAQQTAALGLGVKVNIIGSVFFPIDAHLTPARFCPALTALLKEMGVRFRFSTTIYGWRTEGRRLAAVQTTAGDLIADEFVLTGGSWSPGMISALGARLPMQAGKGYSLTVQRPRLRATKPMILVERRVALTPMGETMRFGGTMEIAGHNDRMRPERLEQIKAGAMAFLPELTPDDFAEARPWFGYRPVTPDGLPYIGRFGRWTNLTAACGHAMLGVTLAPTTGRLVAEVIGGKKPSVNLTLLDPNRYA

SEQ ID NO: 623 - DNA, 1260 bp, Unknown
  Obtained from environmental sample
atgcgcatcctgatcatcggggcgggcgtcattggcgttaccagtgcccattatctgcacaaggcagggcatgaggtcagcatccttgatgcagcacccgccgttgccgaaggggccagccacgccaatgccgggcagataagctggggctatgccagcccctgggcggcaccgggcattccattgaaggcgctgcgctggatgttcagcgcgcatccgcccttgctgatccatggttccaccgactggcggcaatggcgctggctgggctggatgctgcgaaactgcaccgccgaccgctatcgccgcaacaagacctggatgctgtcgctggcacgttacagccagcaggcattggccaccctgcgcgcggaaacgggcctgcgctatgatgacgggcagcgcggtacgctgcaattgttccgcgcgcataaggccatggaagcctcggcggctgacagccatgtgctgacggcgctgaacgtcccgcatgccctgctgacgccgcgtgaatgtgtgaaacgggaaccgggactggcgcatatggtggaccggttggccggcggtttgctgatgccgggggatgagacaggggattgccgcctgttcacccaggggctgagcgaccggttgcggcaggatggtgtcgccctgcatctgaacaccagcgtagcgcagattgtgcgcgacggggatcgggtcaccggcgtgatggcgggcgggcggtttcatgtagccgatgccgtggtgatcgccgccggccatgaaacagtacggctgctgcgaccgttggggttggatctgccggtgctgcccgtgaagggctattcggccactgtgcccatcgtggaagccgaccgtgcgcccgtttccacccttctggacgatcatcataagatcgccgtcacccgcctgggtgaccgtatccgggccgccggcattgcggaactggcggggccggatcaccggctgaccccggcacgctgcaacacggtgcgtcatgtgattgccgacctgttccccagagctgccgacatggcggcgatccagttctggacgggcctgcggcccatgacgcccaatggtgtgccactggtcggggaaagcggcgtaaaaggcctttaccttaacaccgggcacggcaccctgggctggaccatggcgtgcgggtcgggccggctgttggccgatatcatggaggggcacgtcacggatattgatgccgccccctatgcctggccccgcccgtttgccgaatga

SEQ ID NO: 624 - protein, 419 aa, Unknown
  Obtained from environmental sample
  DOMAIN (2)...(398): FAD dependent oxidoreductase
  SITE (96)...(99): N-glycosylation site. Prosite id = PS00001
  SITE (105)...(108): N-glycosylation site. Prosite id = PS00001
  SITE (224)...(227): N-glycosylation site. Prosite id = PS00001
MRILIIGAGVIGVTSAHYLHKAGHEVSILDAAPAVAEGASHANAGQISWGYASPWAAPGIPLKALRWMFSAHPPLLIHGSTDWRQWRWLGWMLRNCTADRYRRNKTWMLSLARYSQQALATLRAETGLRYDDGQRGTLQLFRAHKAMEASAADSHVLTALNVPHALLTPRECVKREPGLAHMVDRLAGGLLMPGDETGDCRLFTQGLSDRLRQDGVALHLNTSVAQIVRDGDRVTGVMAGGRFHVADAVVIAAGHETVRLLRPLGLDLPVLPVKGYSATVPIVEADRAPVSTLLDDHHKIAVTRLGDRIRAAGIAELAGPDHRLTPARCNTVRHVIADLFPRAADMAAIQFWTGLRPMTPNGVPLVGESGVKGLYLNTGHGTLGWTMACGSGRLLADIMEGHVTDIDAAPYAWPRPFAE

SEQ ID NO: 625 - DNA, 1254 bp, Flavobacterium sp. ATCC 27551
atgagggtcgccattctgggcagcggcgtcatcggcgtcacgtccgcctggtatctggcacaggccgggcatgaagtgacggtgatcgaccggcaggacgggccggcgctggaaaccagcttcgccaacgctggagaaatctcgcccggctatgcctccccctgggctgcgccggggataccgatgaaggcgctgcgctggctgttcatgaagcacgccccgctgatcctgcggccgcggatggacatggccatgctacgctggatggtggcgatgctgggcaattgcaacgaacgcgcctatgccatcaacaagagccggatggtgcgcctggccgaatatagccgtgaccggctgatcgacctgcggcgcgaaaccggcatcgcctatgacgagcggtcgcgaggcaccttgcagcttttccgcgagcagaagcagcttgacggcatcgcgaaggacattgccgtgctgaaggcggacggagtgcctttcgaagtgctggatgcggtaggctgcatcgcggcggaaccggggctggcaggcagcggcgtgcctctggccgggggcctgcggcttcccaatgacgaaaccggcgactgcttcaaattcaccaacgcgctggccgacatggcgaaggcgaagggcgtgaccttcctcaacggacggaccatcggaaggatcgccgtcgacaatggaaaggtcagccatgtcgaaaccgacaggggccatgtcgtggccgacgcctatcttgttgcgacgggcagctattccccgcagctgctggccccgctggggatcaggctgccggtctatccggtgaagggctattcgatcaccgttccgatcgtcgatgaggcaagggcgccggtgtcgaccctgctcgacgaaagctacaaggttgcgatcacgcggctgggcgaccgtattcgtgtgggcggcatggcggaactgtcgggctattccaaagggctgcccagggcgcggcgtgatacgctggaatattcggtgggttcgctctttccgggcgcaggcgatctgggcggcgccagcttctggtccgggctgcggccgatgacgccggacagcacgccggtcatcggggcgacgaaagtcccaaacctcttcctcaacaccgggcatggcacattggggtggaccatggcctgtgggtcggggcatgtgatcgcggacatcatcggcgggggcaggccccggatcgaaaccgccgatcttgcgatcagccgctattcataa

SEQ ID NO: 626 - protein, 417 aa, Flavobacterium sp. ATCC 27551
  DOMAIN (2)...(398): FAD dependent oxidoreductase
  SITE (105)...(108): N-glycosylation site. Prosite id = PS00001
  SITE (201)...(230): 2-oxo acid dehydrogenases acyltransferase component lipoyl binding site. Prosite id = PS00189
MRVAILGSGVIGVTSAWYLAQAGHEVTVIDRQDGPALETSFANAGEISPGYASPWAAPGIPMKALRWLFMKHAPLILRPRMDMAMLRWMVAMLGNCNERAYAINKSRMVRLAEYSRDRLIDLRRETGIAYDERSRGTLQLFREQKQLDGIAKDIAVLKADGVPFEVLDAVGCIAAEPGLAGSGVPLAGGLRLPNDETGDCFKFTNALADMAKAKGVTFLNGRTIGRIAVDNGKVSHVETDRGHVVADAYLVATGSYSPQLLAPLGIRLPVYPVKGYSITVPIVDEARAPVSTLLDESYKVAITRLGDRIRVGGMAELSGYSKGLPRARRDTLEYSVGSLFPGAGDLGGASFWSGLRPMTPDSTPVIGATKVPNLFLNTGHGTLGWTMACGSGHVIADIIGGGRPRIETADLAISRYS

SEQ ID NO: 627 - DNA, 1257 bp, Unknown
  Obtained from environmental sample
ttgaaagtcgtgatcctgggggccggcattaccggcgtgagttcggcgtggtttctacgcgaagcgggctttgatgtcacggtgatcgaccgtcagcccgaagccgcgctggaaacgagctttgccaacggcggccagatttccgtctcgcaatccgaaccctgggccaacccggatgcgccgctcaaggtgctcaagtggctctggcacgaagactctcccctgctgttccgcccccgtctcgatgcccgccaatgggcctggggcatgcgctttctgcgtgaatgcctgcctggtcgcaacgaacacaatatcgtgcagctggtgaacctggggctttacagccgcagcaccctcaaggccctgcgcgagagtaccggcatacagtacgaccacctcagccgcggcatcctgcagatcttcttcgaccagcagagcttcgacgctgccgccgagtcctctgccctgatgcggcgctataactgcttccgtgaggccatcccgcgcgagcgtgcggtcgagctggagcccgccctggcggtgctgggcagccgcctgaccggtgccatctgggccgaggatgacgaatcgggcgatgcccgcctctttacccagcaactggccaatctcgcggccgagcgcggggtggagttcctgttcaacacctgcatccgctccctgcaggctgagggcgggcagattaccggcgtgcgcgcctgcgacagcaatggcagtgccaccaccatacagggtgatgcctatttgatctgcctgggcagctatagcccgcaactgttggcgcccctgggcgtcaacctgccggtctaccccaccaagggatattcggccaccatgctgaccgatggctttgagggcgcgcctacggtcagcatcaccgacgacgccatgaagatggtctacacccggctgggtaaccgtatacggattgccggcacggccgagctggatggctacaacaccgaactgaacgatgtgcgttgcgaagccttgatccggcgctacttttcgctcttccccaattctgccgaccccaactcggtgcagtactggaccggcctgcgtccgtccactccctccaatgtgcccatcatcggccgctcgcaattgagcaatctgtatttcaacaccgggcacggcaccctgggctggaccgaaggccccggttcgggccgcgcgattgcggaaatcattgccgggcgtaagcccgaacttgagttcagctttgtcggtacctaa

SEQ ID NO: 628 - protein, 418 aa, Unknown
  Obtained from environmental sample
  DOMAIN (2)...(403): FAD dependent oxidoreductase
  SITE (246)...(249): N-glycosylation site. Prosite id = PS00001
MKVVILGAGITGVSSAWFLREAGFDVTVIDRQPEAALETSFANGGQISVSQSEPWANPDAPLKVLKWLWHEDSPLLFRPRLDARQWAWGMRFLRECLPGRNEHNIVQLVNLGLYSRSTLKALRESTGIQYDHLSRGILQIFFDQQSFDAAAESSALMRRYNCFREAIPRERAVELEPALAVLGSRLTGAIWAEDDESGDARLFTQQLANLAAERGVEFLFNTCIRSLQAEGGQITGVRACDSNGSATTIQGDAYLICLGSYSPQLLAPLGVNLPVYPTKGYSATMLTDGFEGAPTVSITDDAMKMVYTRLGNRIRIAGTAELDGYNTELNDVRCEALIRRYFSLFPNSADPNSVQYWTGLRPSTPSNVPIIGRSQLSNLYFNTGHGTLGWTEGPGSGRAIAEIIAGRKPELEFSFVGT

SEQ ID NO: 629 - DNA, 921 bp, Unknown
  Obtained from environmental sample
atggacatcggattcggggcgccagtggcgggcgcgtgggcgacgccacgcaacctcacggagttcgcgcggcgggcggaacggctgggctatcggtcgctgtggacgttccagcggctgctggtgccgcgggaggccgacatggcgcccgtctaccagagcgtgctcgacccgatggtggcgctcggctacgcggcggccgtgacgtccgtgatccggcttggggtcgcggtcatcaaccacccgttcgtctctcccgcgtacctggcgaagcaggcggccacggtggacgtgctctctggcgggcggctcgacctcggcatcgggatcggctggctgccccaggagttcaccgcctccggagccagcatggacaagcggggcccgcgcaccggggagtacctggccgcgatgcgcgcgctgtgggcggacgggaccagcgagttccacggcaggttccatgagatcccggcgggacggcaggacccgtctccggtgcagcgtcccggcccgccggtgctgcttggcgggatgtcgcggcaggcgatggagcgcgccgggcggatcgcggacggctgggtcaccgcgagcgccgccgacctgtccaaggtggcggagtccgcgcggatcgtgcaggaggccgccgcggcggccgggcgcggcccggtccggatcgtgtgccgtggtgtggtgcgggccggccagcaggtaaagtccccttcgggtgagcggatgctgctgtccggaagctacgcgcagatccgcgaggacaccgcgtggctggaaagctgcggggtgaccgaggtgttctacgacctgaactgggatccggcggtcgggaacccggccgctgacgagggtgccgcggtgctgcgagccgccgagatcctcgaggcgctcgccccggacggtgccctatga

SEQ ID NO: 630 - protein, 306 aa, Unknown
  Obtained from environmental sample
  DOMAIN (1)...(304): Luciferase-like monooxygenase
  SITE (18)...(21): N-glycosylation site. Prosite id = PS00001
MDIGFGAPVAGAWATPRNLTEFARRAERLGYRSLWTFQRLLVPREADMAPVYQSVLDPMVALGYAAAVTSVIRLGVAVINHPFVSPAYLAKQAATVDVLSGGRLDLGIGIGWLPQEFTASGASMDKRGPRTGEYLAAMRALWADGTSEFHGRFHEIPAGRQDPSPVQRPGPPVLLGGMSRQAMERAGRIADGWVTASAADLSKVAESARIVQEAAAAAGRGPVRIVCRGVVRAGQQVKSPSGERMLLSGSYAQIREDTAWLESCGVTEVFYDLNWDPAVGNPAADEGAAVLRAAEILEALAPDGAL

SEQ ID NO: 631 - DNA, 1233 bp, Unknown
  Obtained from environmental sample
atgagattcgataccgtggtgctcggcgccggcattgtcggggtgtgcgtcgccgtgcatctgcagaaacgcgggcggtcggtcgcgctgatcgaccgcaagctgccgggcaacgagacctcgttcggcaacgccgggctgatccagcgcgaaggcgtctatccgtacgcgtttccgcgcgggctcggcaccctgctgcgctacgcgcgcaaccagtcgcccgacgtgcgctatcacgccgacgcgatgctccacgtcgcgccgtttctttggcgctactggcgcaactcgcatccggcgaagcacgcggaaatcgcgaagtcgtacgcgacgctgatcgagcattgcgtcaacgaacatcgcgcgcttgccgccgacgccggtgcgagcgcgctgctgcggccgatcggctggatcaaggtgtttcgccacgccgccgcgcgcgacgccgaaacgacgctcgccgaacggtggcatcgcgaatacggcgtcgaattcgaaacgctcgacgcgccgcgcctgcaacaactcgaacccgatctcgacaaacgcctgcaaggcgggctgcgctatccgcaatccgattcggtcagcgatccgaacgcgctcgtcaccgcgtacgcgcggtacttcgaaacgctcggcggacggttcttcatcggcgatgccgacacgctgcgtgagggctggcaggtcgagacgcaggacggcgcgatcacggcgacgtcggcggtgatcgcgctcggaccgtggtcggatcgcgtgaccacgcggctcggatatcagctaccgcttgcggtcaagcgcgggtatcacatgcactacgcgccgcgccggaccgcgcggctcaatcatccgattctcgacgtcgaacacggctatgtgctcgcgccgatggcgcgcggcatccgcctgaccacgggcgccgagatcgcgcggcccgaggcggccaagacgccggtgcagctcgatgcggtcgagccgatcgcgcgcacgctgtttccgctcggtgaacggctcgacgcggaaccgtggatgggacgccgcccgtgcacgccggacatgatgccgatcatcgggcccgcgaacaaacatcagggactgtggttcgcgttcggccacgcgcatcatggtttgacgctcggaccggtgacagggcggctgatcgccgaaatgatgacgggcgaggagacgctggtcgatccacgaccgtttcgggtcgaacggttttag

SEQ ID NO: 632 - protein, 410 aa, Unknown
  Obtained from environmental sample
  DOMAIN (4)...(392): FAD dependent oxidoreductase
  SITE (38)...(41): N-glycosylation site. Prosite id = PS00001
MRFDTVVLGAGIVGVCVAVHLQKRGRSVALIDRKLPGNETSFGNAGLIQREGVYPYAFPRGLGTLLRYARNQSPDVRYHADAMLHVAPFLWRYWRNSHPAKHAEIAKSYATLIEHCVNEHRALAADAGASALLRPIGWIKVFRHAAARDAETTLAERWHREYGVEFETLDAPRLQQLEPDLDKRLQGGLRYPQSDSVSDPNALVTAYARYFETLGGRFFIGDADTLREGWQVETQDGAITATSAVIALGPWSDRVTTRLGYQLPLAVKRGYHMHYAPRRTARLNHPILDVEHGYVLAPMARGIRLTTGAEIARPEAAKTPVQLDAVEPIARTLFPLGERLDAEPWMGRRPCTPDMMPIIGPANKHQGLWFAFGHAHHGLTLGPVTGRLIAEMMTGEETLVDPRPFRVERF

SEQ ID NO: 633 - DNA, 1293 bp, Unknown
  Obtained from environmental sample
atgaaagtcattgttctcggcgccggcgtgatcggaaccaccacggcgtactacctcgccaaggccggcgcggaggtgacggtgatcgaccgccaaaacgcctgcgcgatggaaaccagcttcgccaatgccggccaggtatcgccgggctactccacgccctgggcagcgcccggcattccgctcaaggcggtgaagtggatgtttcagcgccatgcgccgctggcgattcgtccagacggcacgctgtggcaattgcgctggatggcgcaaatgttgcgcaactgcagcgctgaacgctatgcggtgaataaagagcgcatgatgcgtctggccgagtacagccgcgccagcctgcaagcgctgcgcacggaaaccggcatcgcctacgagcagcgcaccggcggcacgctgcaggtgtttcgcagtcaggtgcagctcgatgcggtgcagcgcgacgtgaccgtgctcgaagaatgcggcgtgccctacgaactgctcgaccgcgaccaactcgcccaggtcgagcccggtctggcgcacgcccgcgaccggcttgtcggcggcctgcgcctgccgcacgacgaaaccggggattgccagatattcaccatccgtctgggcgagatggcgcgcgaactgggcgtgaaattcgagttcggccagaccctccgcggactgtcgagcgacggccagcgcatcaccggcgtgcaggtgggagacgccgtactcaccgcggatcgctatgtgctggcgctgggtagttacacccgcgactttctggcgccgctgggcctcgatctgccggtctatccggtcaagggctactcgctcaccgtgccgctgaccgacgagtcgctcgcgccgcggtccaccgtgctggacgaaacctacaaaatcgccctcacccgcttcgatcaacgcatccgcgtgggcggcatggcggagctgggcggattcgatctgcggctcaacccgcgtcggcgcgaaacactggaaatggtcacccgcgatctgttccccggtggcgacctcgccgctgccaccttctggaccggcctgcgtccgatgacgcccgacagcacgcccatcgtcggcgccacgcgctatcccaacctctacctcaacaccggccacggcaccctggggtggaccatggcctgcggttcaggccgggtcgtgagtgatctggtgctcaaccgcaagccggagatcagcatcgccggtctgggtatcgagcgctacgaccgcccggccacgccgcccaaagtgctgcattccagccacgcctga

SEQ ID NO: 634 - protein, 430 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
MKVIVLGAGVIGTTTAYYLAKAGAEVTVIDRQNACAMETSFANAGQVSPGYSTPWAAPGIPLKAVKWMFQRHAPLAIRPDGTLWQLRWMAQMLRNCSAERYAVNKERMMRLAEYSRASLQALRTETGIAYEQRTGGTLQVFRSQVQLDAVQRDVTVLEECGVPYELLDRDQLAQVEPGLAHARDRLVGGLRLPHDETGDCQIFTIRLGEMARELGVKFEFGQTLRGLSSDGQRITGVQVGDAVLTADRYVLALGSYTRDFLAPLGLDLPVYPVKGYSLTVPLTDESLAPRSTVLDETYKIALTRFDQRIRVGGMAELGGFDLRLNPRRRETLEMVTRDLFPGGDLAAATFWTGLRPMTPDSTPIVGATRYPNLYLNTGHGTLGWTMACGSGRVVSDLVLNRKPEISIAGLGIERYDRPATPPKVLHSSHA

SEQ ID NO: 635 - DNA, 1296 bp, Unknown
  Obtained from environmental sample
atgaaagtcattgttctcggtgcgggggtgattggaaccaccacggcctactatctcgccaagtccggcgcggaggtcaccgtcattgaccggcaggacgcctgcgccatggaaaccagcttcgccaacgcgggtcaggtgtcccccggctactccaccccctgggccgcgccgggcattccgctcaaggcggtgaaatggatgttccagcgccatgcgccgctggccatccgacccgacggcagcctgtggcaactgcgctggatggcgcagatgctgcgcaactgcaccgcagagcgctacacggtcaacaaggaacgcatgatgcggctggccgaatacagccgcgccagcctgcaggcactgcgtgccgaaaccggcatcgcctacgagcagcgcaccggcggcacgctgcaggtgtttcgcagccagtcgcagctcgacgcggtgcagcgcgacgtggccgtgctggaggaatgcggcgtgccctaccagttgctcgaccgcgaccagcttgccactgtcgagcccggcctggcccacgcccgcgaccgtctggtgggcggcctgcgtctgcccaacgatgaaaccggcgactgccagttgttcaccacccgcctgggcgagatggcccgcgccctgggtgtggagttccgcttcggccagaccatcagcggcctgtctggcgacggccagcgcatcaccggtgtgcgggtgggcgatcaaaccctcactgccgatcgctatgtgctggcgctgggcagctacacccgcgactttctcgcgccgctcgggctggatttgccggtctatccggtcaagggctactcactcaccgtgccgctggtgaatgaggcgctcgcgccgcgctccaccgtgctcgatgagacttacaaaatcgccgtcacccgttttgacaagcgcattcgcgtgggcggcatggccgagctgggcggattcgatctgcgcctcaacccgcgtcggcgcgaaacgctggaactggtcacccgcgacctgttccccggcggcgatctggccgcagccgacttctggaccggcctgcgccccatgacccccgacagcacgccgatcgtcggcgccacacgctaccccaatctgttcctcaacaccggccacggcaccctgggctggaccatggcctgcggctcgggccgcgtggtgagcgatctggtcttgaaccgcaagcccgacatcagcaccgaaggactcgggctggagcggtatgcaccgcacgcgcccgcaccacgtctgcagcatcactccaaacccgcatga

SEQ ID NO: 636 - protein, 431 aa, Unknown
  Obtained from environmental sample
  SIGNAL (1)...(20)
  DOMAIN (2)...(397): FAD dependent oxidoreductase
  SITE (96)...(99): N-glycosylation site. Prosite id = PS00001
MKVIVLGAGVIGTTTAYYLAKSGAEVTVIDRQDACAMETSFANAGQVSPGYSTPWAAPGIPLKAVKWMFQRHAPLAIRPDGSLWQLRWMAQMLRNCTAERYTVNKERMMRLAEYSRASLQALRAETGIAYEQRTGGTLQVFRSQSQLDAVQRDVAVLEECGVPYQLLDRDQLATVEPGLAHARDRLVGGLRLPNDETGDCQLFTTRLGEMARALGVEFRFGQTISGLSGDGQRITGVRVGDQTLTADRYVLALGSYTRDFLAPLGLDLPVYPVKGYSLTVPLVNEALAPRSTVLDETYKIAVTRFDKRIRVGGMAELGGFDLRLNPRRRETLELVTRDLFPGGDLAAADFWTGLRPMTPDSTPIVGATRYPNLFLNTGHGTLGWTMACGSGRVVSDLVLNRKPDISTEGLGLERYAPHAPAPRLQHHSKPA

SEQ ID NO: 637 - DNA, 1128 bp, Unknown
  Obtained from environmental sample
atgacccaggcagacttcatcatcatcggcggcgggatcgccggggcatccaccggctactggctgtcgcgccatggccgggtactggtgctggagcgcgaatcccatccggcctaccactccaccggacgctccgcggccctctacaccgccgcctacggcaccgcccaggtacgtgccctgaccctggccagccgagactttttcgacgccccgcccgaaggcttctgcgaacacccgctgctgaccccgcgcggcgaaatgaccgtggacttcaccggcgaccccaccgagctgaacaaccagtacctcagcgccaaggccacggtgccggaagtacagctgctcagcgccgacgaagcctgcgcgcgcctgccgatcctgcgccgcgagaaagtccacggcgcgctgtacgacccgagcgccagcgacatcgataccgacgccctgcaccagggctacctgcgcggtatccgccgcaaccagggcgaaatccgcaccgactgcgaagtgctggggctgagccgcgacgcacagggcctctggcaggtgcgaaccgccggccagaccttcagcgcgccgatcctgatcaacgccgccggcgcctgggccgaccagctcggcgtaatggccggcgcccggcctttgggcctgcagccgaaacgccgcgcggcctttatcttcgccggacccgaaggcgtcgacagccatcgctggccgatgctggtgagcctcgacgaatccttctacatgaagcccgacgccggcatgttcctcggctcgccggccaacgccgacccggtggaaccccacgacgtgcagccggaagaactggacatcgccatgggcatctaccagatcgaagaagccaccaccctgacgattcgccgcccgacccggacctgggccgggttgcgcagtttcgtcagcgacggcgacctgctggccggcttcgacacccaggtgccggggctgttctgggtcgccgcgcaaggcggctacggcatccagacctcgcctgccatgggccaggccagcgccgccctggtgcgcggcgaagccctgccggaacagctggcgcgctttggcctggatagcgccatgctctcccccgcccgtctcggctga

SEQ ID NO: 638 - protein, 375 aa, Unknown
  Obtained from environmental sample
  DOMAIN (5)...(349): FAD dependent oxidoreductase
MTQADFIIIGGGIAGASTGYWLSRHGRVLVLERESHPAYHSTGRSAALYTAAYGTAQVRALTLASRDFFDAPPEGFCEHPLLTPRGEMTVDFTGDPTELNNQYLSAKATVPEVQLLSADEACARLPILRREKVHGALYDPSASDIDTDALHQGYLRGIRRNQGEIRTDCEVLGLSRDAQGLWQVRTAGQTFSAPILINAAGAWADQLGVMAGARPLGLQPKRRAAFIFAGPEGVDSHRWPMLVSLDESFYMKPDAGMFLGSPANADPVEPHDVQPEELDIAMGIYQIEEATTLTIRRPTRTWAGLRSFVSDGDLLAGFDTQVPGLFWVAAQGGYGIQTSPAMGQASAALVRGEALPEQLARFGLDSAMLSPARLG

SEQ ID NO: 639 - DNA, 1002 bp, Unknown
  Obtained from environmental sample
gtgtcccaagctcctgttcggattggtgttgtcggcctcggttactggggcccgaatctcgcgcgaaacttcgcaaacctgccggaggcgcagctgcgctggtgctgcgacgcctccgaccaagcgcgggcgcgagtcgccgcgctgttccccggcgccaagctgtcggattcccttgatgagctgctcgacgaccctgaactcgacgcggtggtgctggcaacgccggtaccgacgcacgccgatctggcggtgcgcgtcctggaggccggcaagcactgcttcgtcgagaagccgctggcgcaatcggtcgccgacgcgcagcgggccgtcgatgccgccgcacgcactggtaagacgctgttcgtcggccatctgctcgaataccacccgggtgttcgcaagctcaaggagctcgccgatagcggtgagctgggcgagatctactacatctacgggaaccggctgaacctcggcaagctgcgggccgacgagaacgcgctgtggtcgcttggcgcgcatgacatctcggtgctgctggcgctggcgggcgaggagccgatcgagctggtcgcccacggtgagtcctacgtgcgtcccggcgttgaggatgtcgtcttctgcttcctgcggttcccgtcggggctctcagcgcacctacatctgagctggctggacccgcataaggaacgccgcttcacggtcgtcggcgcgaagcggatggcgaccttcgacgacatggcgctcgagggcaaggtcacgatctacgacaagggcttcgatgaggcgaccagcgggtacggcgagtacatcacccgttccggcgacatcttctcgccgcggctgccgagcgtcgagccgctgcgcgtcgaatgccagcacttcgtgcagagcatcctgaccggtgaacggccccgctccgacggcgagagcgggctgcgggtcgtgcgggtcctggagggtctgcagaactcgctgaagcggtccgcccgtgagcgctag

SEQ ID NO: 640 - protein, 333 aa, Unknown
  Obtained from environmental sample
  DOMAIN (6)...(125): Oxidoreductase family, NAD-binding Rossmann fold
  DOMAIN (7)...(113): Semialdehyde dehydrogenase, NAD binding domain
  DOMAIN (12)...(124): Homoserine dehydrogenase, NAD binding domain
  DOMAIN (137)...(235): Oxidoreductase family, C-terminal alpha/beta domain
MSQAPVRIGVVGLGYWGPNLARNFANLPEAQLRWCCDASDQARARVAALFPGAKLSDSLDELLDDPELDAVVLATPVPTHADLAVRVLEAGKHCFVEKPLAQSVADAQRAVDAAARTGKTLFVGHLLEYHPGVRKLKELADSGELGEIYYIYGNRLNLGKLRADENALWSLGAHDISVLLALAGEEPIELVAHGESYVRPGVEDVVFCFLRFPSGLSAHLHLSWLDPHKERRFTVVGAKRMATFDDMALEGKVTIYDKGFDEATSGYGEYITRSGDIFSPRLPSVEPLRVECQHFVQSILTGERPRSDGESGLRVVRVLEGLQNSLKRSARER

SEQ ID NO: 641 - DNA, 1128 bp, Unknown; identical to SEQ ID NO: 637
  Obtained from environmental sample

SEQ ID NO: 642 - protein, 375 aa, Unknown; identical to SEQ ID NO: 638
  Obtained from environmental sample
  DOMAIN (5)...(349): FAD dependent oxidoreductase

SEQ ID NO: 643 - DNA, 1266 bp, Unknown
  Obtained from environmental sample
atgacccgggcccggcatgtggtcgtgatcggcgccggcgtggtcggcagctgtactgcgcaggctttggccgagcgtgggctggccgtgaccctggtcgaccggcatgccgaagcggcggccgagaccagccacgccaacggtggttgcctgactcccggccatgccgagccctggaactcgcccggcattgccgcgcgcctgctgcgccggtctggccagcacgagccgttccgcatctttgcccacgctctgccgggcttgcttggctggggctggcaatttctgtggcagtccaaggcctcgcgctactaccgcaatgcccgcgccaacacccgcctggcggtcttttcgggtcaatgcctggccgagctgcgccagcgccatgtcttcgactaccacgcctggaccgagggttcgctggagctgtatttcgattcggccgaactcgaacatgccgccgaactgcggcggcagatcggcgatcccggggtgaagatcgaagcgattgatgtcgcgcgcgtgatcgaactggaaccggccctggctccggttgccgggcgcatggttggcggcctgttgatgcccaggcatgagtcgggcgatgtctgcgagttctcggccgagatggcccgcctggcggccgaacagggtgccagcttgcgcttcggttcggccgtgcggcgtatcgtcagcgaccggggccgggtgcttggagtcgaactggccgacgaactgatcgaggccgatgcggtggtactcgcggctggcgtggccagcccggccctggcccggccgctggggctgaagttggcgatccagccggtcaagggctattcgctgacgctggagctggaacagcccgaactggccccgacgatgccgctgctggacctggaacaacgcatcgtcgcctcgcgctacggcaatcgcctgcgcctggccggactggctgatttcgacggttatagccgccaggttcgtccggagcgcttgcagctcctggtcgattcggcctgtaccctgctgccccgtttgagcgatgaaatccgctccgaccgagccgaagcctggaccggcctgcgcccgatgacgcccaagggcccgccgatgctgggtccgacccccgtgcccggacttttcctgaacaccggccacggctcgatgggctggacccaggccgccggctcggccaggatcctggccgacctgctgaccgggcgggagccgcagatcaatctgtccggattggggtatcggggttaa

SEQ ID NO: 644 - protein, 421 aa, Unknown
  Obtained from environmental sample
  SIGNAL (1)...(24)
  DOMAIN (6)...(404): FAD dependent oxidoreductase
  SITE (419)...(422): N-glycosylation site. Prosite id = PS00001
MTRARHVVVIGAGVVGSCTAQALAERGLAVTLVDRHAEAAAETSHANGGCLTPGHAEPWNSPGIAARLLRRSGQHEPFRIFAHALPGLLGWGWQFLWQSKASRYYRNARANTRLAVFSGQCLAELRQRHVFDYHAWTEGSLELYFDSAELEHAAELRRQIGDPGVKIEAIDVARVIELEPALAPVAGRMVGGLLMPRHESGDVCEFSAEMARLAAEQGASLRFGSAVRRIVSDRGRVLGVELADELIEADAVVLAAGVASPALARPLGLKLAIQPVKGYSLTLELEQPELAPTMPLLDLEQRIVASRYGNRLRLAGLADFDGYSRQVRPERLQLLVDSACTLLPRLSDEIRSDRAEAWTGLRPMTPKGPPMLGPTPVPGLFLNTGHGSMGWTQAAGSARILADLLTGREPQINLSGLGYRG

SEQ ID NO: 645 - DNA, 1245 bp, Unknown
  Obtained from environmental sample
atgtctcgtgaaaccgtcgttctgggagccggcatggtcggcgtctccatcgcctggcatctggctcgtcgcggtcgctcggttcttctggtggatcgccgaccgcccggccaggagacgtcctatggcaatggcgggctgattcaacgcgaggcggtacgcccctatacctttccgcgcgaacttggcaagttgctgagttcactaccgaaccggcgggtcgacattcgctaccaatggcgcggtgtgctgcagttcgccgggcctctgctcggctattggcgatattcggctgccacgccctatgcgcgcatcgtgcccgagtacgcctctttgattgccctgagcacagaggagcatgcaccgatgatcgcggccgccggtgcgggggagttgatcggcaagaagggctggctcgaagtccatcgcagccaggcggaattcgatcgccgtgcacgagaggctgaggatgccgccaatcgcttcggtgtgacgcatgagcgcctcgatggcgcggggctcgctcacaaggagcccgagttgagccccggcctggcaggggcaattcactggaccaattcctggagcgtggccgaccctggcggtctggttaccgcctatgcgcgcagcttcgaacagcagggcggtgaatttcttcaggccgcggtgcaggacgtgagtcaggtggggggcggctggcgtatcggcaccgaccagggagatatcgaagcccgcgatgtcgtactggcgtttggcccctgggccggcccctggctcaaggcgttgggctaccgcttgccgaccttcgtcaaacgcggttatcacatgcactatggcgctgccgagggaaggcgtatttctcattggctggccgatgccgatatcggctatatcctggcgccgatgcgggccgggattcggctcaccaccggagctgagcttgcctgtctcgatgcgccacccgcccacggtcagctggctgccgccgagcgctgcgcccgcgaactctatccttgcctgggcgagcgcctcgaggcggaaccgtggaggggggcgcgtccgtgcctgcctgacatgaagcccgtgattgggcctgcgccacgtcatcgcgggttatggttcgccttcggtcatggccaccagggcttcaccatggggccggccactgggcgtgtgctggcggaactcatggaaggggagcccaccgccgtagacctcacaccgtttcgcgccgaccgtttctag

SEQ ID NO: 646 - protein, 414 aa, Unknown
  Obtained from environmental sample
  DOMAIN (4)...(396): FAD dependent oxidoreductase
MSRETVVLGAGMVGVSIAWHLARRGRSVLLVDRRPPGQETSYGNGGLIQREAVRPYTFPRELGKLLSSLPNRRVDIRYQWRGVLQFAGPLLGYWRYSAATPYARIVPEYASLIALSTEEHAPMIAAAGAGELIGKKGWLEVHRSQAEFDRRAREAEDAANRFGVTHERLDGAGLAHKEPELSPGLAGAIHWTNSWSVADPGGLVTAYARSFEQQGGEFLQAAVQDVSQVGGGWRIGTDQGDIEARDVVLAFGPWAGPWLKALGYRLPTFVKRGYHMHYGAAEGRRISHWLADADIGYILAPMRAGIRLTTGAELACLDAPPAHGQLAAAERCARELYPCLGERLEAEPWRGARPCLPDMKPVIGPAPRHRGLWFAFGHGHQGFTMGPATGRVLAELMEGEPTAVDLTPFRADRF

SEQ ID NO: 647 - DNA, 1296 bp, Unknown
  Obtained from environmental sample
atgaaaatcgccgttctgggcgccggggtcgtgggaacgaccaccgcctactaccttgcacgtgccggccatgaagtcgacgtctacgaacgtcaggacggcgctgccctcgaaaccagttttgccaacgccggccagatttccttcggatattcatcgccgtgggcggcgcctggagtcccgctcaaggccgtgaagtggatgttcgccaagcacccgccgttgacgatccgtcccgatggctctttgacgcagttacgctggatgttcgacatgtggcgcaactgcaccgccgcccgttacgccgtgaacaaggagcggctgctgcgcatctccgattacagccggcattgcctggcgcagttgcgagaggaaaccggcatcgaatacgaaggcaggcagcggggcacgctgcaactgtttcgcacggagcagcagctcgaggccgccgcccgggacatgcgggcgctcgctgaggcaggcgtaccgttcgagttgctgacttctgaacaactggccgacgccgagccggggctggcagcgagtgcgcacaagtttaccggcggcctgcgcacacccggcgacgaaacgggcgactgccacctcttcaccacccggctggccgagcaggcccggaaattgggcgtccgcttccactacggcatgccactcgacacgctgctcacggaaggcaataccgccgtcggcgttcaaagcggtggccatcgcattgaggccgatgcgtacgtactggccctcggttcgtggtccagccgcttcctgcgcggcgtgctgcgcctcccggtctatccgctcaaggggtattccatcaccgtgccaatcgccgatgaatcgcgggcgcccgtctctaccctgctcgacgaaagctacaaagtggccgtgacgcgattcgatgatcgtatccgggtcggcggcatggccgagatcgtcggctacgacatgcgtctcaacccccgccgccaggcgactcttgaaatggtggtggatgacctgttcccgggtgcaagacggccaggaaacgtcacattctggactggtttacggcccaagacacctgacagcacgcccatcatcggctcgacacccgtgaagcggctgtatctgaacacaggccatggcacactgggctggaccatgtgttgcggcagcggccgcctgctggcggacatcatttcagggcgtgcgccagagattcgcgccaacgatctttctgtgcatcgctactacggcagcctgccgggcaacccgccatcgggccggcctgccactgcttga

SEQ ID NO: 648 - protein, 431 aa, Unknown
  Obtained from environmental sample
  DOMAIN (2)...(397): FAD dependent oxidoreductase
  SITE (96)...(99): N-glycosylation site. Prosite id = PS00001
  SITE (352)...(355): N-glycosylation site. Prosite id = PS00001
MKIAVLGAGVVGTTTAYYLARAGHEVDVYERQDGAALETSFANAGQISFGYSSPWAAPGVPLKAVKWMFAKHPPLTIRPDGSLTQLRWMFDMWRNCTAARYAVNKERLLRISDYSRHCLAQLREETGIEYEGRQRGTLQLFRTEQQLEAAARDMRALAEAGVPFELLTSEQLADAEPGLAASAHKFTGGLRTPGDETGDCHLFTTRLAEQARKLGVRFHYGMPLDTLLTEGNTAVGVQSGGHRIEADAYVLALGSWSSRFLRGVLRLPVYPLKGYSITVPIADESRAPVSTLLDESYKVAVTRFDDRIRVGGMAEIVGYDMRLNPRRQATLEMVVDDLFPGARRPGNVTFWTGLRPKTPDSTPIIGSTPVKRLYLNTGHGTLGWTMCCGSGRLLADIISGRAPEIRANDLSVHRYYGSLPGNPPSGRPATA

SEQ ID NO: 649 - DNA, 1245 bp, Unknown
  Obtained from environmental sample
atgtcgcgcaatatagtcgttctgggtgctggtatggtcggcgtgtccgttgcctggcacctgatccgcagagggcacagggtcacgctggtggaccgtcgcgaaccgggacgggaaacctccttcggcaatgccggggtcatccagcgcgaggctgttcgcccttacgggtttccccgggacataggcaccctgctgcgggttctgcccaatcgccaggtggatatccgctaccggccgacgggcatgctgaatgccgcggttccgctgttccagtactggctcaattccggtggccagcgctaccagcgtatcgtgcgggaatgggcatcgctgatccagcgctgccagcacgcccatggccccatgatcgaggccgccggtgcctgggatctggtacgcaagggcggctggctggagctgtaccggactcgaaaggcgctggaagagcgcgttgccgaggccaatgaggaccgaggccgtttcggtatcgagttcgacgtactcgacgcaccacggttgcgtgcccgcgagccatggctggcgaaggacctgatcggtgccatccactggacccagccctggatggtcagcgatccaggtgcgctggtgcaggcctatgcccggaacttcgtcgagcagggggggaagttgatgcaggccagcgtcgaggatgtcctggaggagggcggccgctggcgaatcctgacctcggaaggcgagctgcaggcagatcaggtggtcgtggccatggggccgtggtccagtcggctgctggcccgtgtcggcatccgcgtgcccctgttcgtcaagcgcggttaccacatgcactacagcacgggtgaaggcgccgaactgaatcactggctgatggatgcggaacggggtttcatgatggagcccatgcgtgccggcatccgcctgaccaccggcgccgagctggcggacctggatgcgccgccgaaatacgggcagctggccgcggcggagaaggcggcgcgggcactcttcccggcactgggtgagcgactggaccccagcccatggaaaggcgcgcgtccctgcctgccggacatgaagcccgtgatcgggccggcgccccagaagggcctgtggctggcattcggacatggtcaccagggctttaccctgggaccggctaccggcgagctgctggcgcagatgatggatggggagacgccggccatcgacatggcgccgttcgcggtgcaacgtttcctctga

SEQ ID NO: 650 - protein, 414 aa, Unknown
  Obtained from environmental sample
  DOMAIN (4)...(395): FAD dependent oxidoreductase
MSRNIVVLGAGMVGVSVAWHLIRRGHRVTLVDRREPGRETSFGNAGVIQREAVRPYGFPRDIGTLLRVLPNRQVDIRYRPTGMLNAAVPLFQYWLNSGGQRYQRIVREWASLIQRCQHAHGPMIEAAGAWDLVRKGGWLELYRTRKALEERVAEANEDRGRFGIEFDVLDAPRLRAREPWLAKDLIGAIHWTQPWMVSDPGALVQAYARNFVEQGGKLMQASVEDVLEEGGRWRILTSEGELQADQVVVAMGPWSSRLLARVGIRVPLFVKRGYHMHYSTGEGAELNHWLMDAERGFMMEPMRAGIRLTTGAELADLDAPPKYGQLAAAEKAARALFPALGERLDPSPWKGARPCLPDMKPVIGPAPQKGLWLAFGHGHQGFTLGPATGELLAQMMDGETPAIDMAPFAVQRFL

SEQ ID NO: 651 - DNA, 1236 bp, Unknown
  Obtained from environmental sample
atggcacgggaagtcatcgttttgggcgccggcatcgtcggcgtgagcaccgcggcccacctcgcgctgcgcggtttcgccgtcacgctcctggaccgcaagagcccggggcgcgaaacctcgtacggcaatgcgggcgtgatccagcgcgaagccgtcgagcccttcgggtttccccaggacatgcgcacgctgtaccgcgcggcgctcaagatcggcgccaaggtcaactaccacctgggcgcgctgcccgggatggcgggcgagctggtgcgttattggtcgaactcgcgccccgcagcgcacgcgctcgtctcgcagcatcacgcgcgcatgatcggccactgcctgtccgagcacgagttcctgatgtccctggccggcgcgcaggacctggtccggcgcgccggttttcgcttcctctatcgcgagcaggccacgatggacagtgccatctcgcgcgcgcaaaggctggagcgggagtacggcgtcactttctcggtagaagacggccgcgagatcaggcggctcgagcctcacctgaagcgcgaagtggccggcgcggtgcactggctggacccgtggtcggtgaacgatccgggcgaactcgtttcgcgatatgccgcgctcgtcgtgaagcacggcggccgcatcgtcaccggcgatgcgcaatcgctgcagcccacggcgacaggctggtgcgtggattcggacaacggccacatcgaggccgaactggcggttgtcgcgctcggcccctggtcggccgaactcgcaaagacactcggctaccgtttcccgctcatcccgatccgcggctatcaccagcactacgacggcgcgggacccgacctgccgatggtcgatgtggacggcggctatatggtgtcgccgatgcggcaaggcgcgcgcatcacgaccggcggcgagttcggccggctcgaatcggcctccacgcccgtgcaactggcgcgcgcggaaaagctggcgcgcgaactgttcgacctcggcgatgcaccggattcaccgccgtggcgcggcgcgcggccctgcatggtggacctgctgccggtgatggggccggccagcaaacatccaggcctgtggttcaacttcggccacgcgcaccagggcttcacgctggggccggtgagcggccgtttgctggcggagatgatcgcgggcgaatcgacgttcatcgacgcgcgcccttacacgcccgcacgcttcggatag

SEQ ID NO: 652 - protein, 411 aa, Unknown
  Obtained from environmental sample
  DOMAIN (4)...(392): FAD dependent oxidoreductase
MAREVIVLGAGIVGVSTAAHLALRGFAVTLLDRKSPGRETSYGNAGVIQREAVEPFGFPQDMRTLYRAALKIGAKVNYHLGALPGMAGELVRYWSNSRPAAHALVSQHHARMIGHCLSEHEFLMSLAGAQDLVRRAGFRFLYREQATMDSAISRAQRLEREYGVTFSVEDGREIRRLEPHLKREVAGAVHWLDPWSVNDPGELVSRYAALVVKHGGRIVTGDAQSLQPTATGWCVDSDNGHIEAELAVVALGPWSAELAKTLGYRFPLIPIRGYHQHYDGAGPDLPMVDVDGGYMVSPMRQGARITTGGEFGRLESASTPVQLARAEKLARELFDLGDAPDSPPWRGARPCMVDLLPVMGPASKHPGLWFNFGHAHQGFTLGPVSGRLLAEMIAGESTFIDARPYTPARFG

SEQ ID NO: 653 - DNA, 1344 bp, Unknown
  Obtained from environmental sample
atgacagacagcttcgacctgatcgtgctcggcgccggctccggcggcctggccacggccttccgcgccgcgcgccacggcgcgcgggtggccctgctggaatccggcgtgctgggcggcacctgcgtcaacgtcggctgcgtgccgaagaaggcgatgtggtacgccgcgcagatggccgagatgcagcagctggccgtcgactacggtttcgccagccggcccgggccgctggactggccgaccttcgtggcgcaccgccaggcctacatcgaccgcatccacgccggctaccgcaagcgcctggccgaatcgggcgtcgaactgatcgcggcccgcggcgcgctggacgggccgcatgcggtgaaggcgggcggacgcagcctgcaggcgccgcacatcgtcgtcgccaccggcgcgcggccgcgccgcctggacacgccgggcttcgaactgggcatcgtctccgacggcttcttcgacctgcgggcaagtccgcggcgcgtcgccatcgtcggcggcggctacatctcggtggaactgggcggcgtgctgcgcgcgctcggcgccgaggtggagatcttcgcgcgcggccacctgatgcgcggcttcgacgcgcacctgagcttggcgctgggcgaggcgatgcgcgagctgggcatccgcatccactaccagtgcgacatcgaagcggcgcggcgcgaaaaggacggcgtcgtgctcgactgcagcgcgggcgaccgcatgggtccgtacgacgtgctgctgtgggcggtcggacgcgtgccgaacagcgacggcatcggtctcgaggcgcagggcgtggaactcgacgcccgcggccacgtgctggtcgatgcgcggcagaacaccgccgccgcgggcatctacgcgatcggcgacgtcaccgaccggctggcgctgacgccggtcgcgatcgccgccgggcggcggctggccgatcgcgtgttcggcggcgacgacgatgcgttcctcgactacgagaacatccccagcgtggtgttctcgcacccgccgctggccggcgtcggcctgaccgagcaggccgcgcgcgagctgcacggcgatgccgtgcgggtcttcacctcgcgcttcacgccgatgcagctggcgctgtcggcgcacccgcaaccgatgctgatgaagctggtctgcgccggcgacgagcagcgcgtggtcggcgtgcacatgctcggccccggcgccgacgagatactgcagggcttcgcggtcgcggtgaagatgggcgcgcgcaaggccgatctcgacgccacggtggcgatccatccgacgtcggcggaggagttggtgttgatgggttga

SEQ ID NO: 654 - protein, 447 aa, Unknown
  Obtained from environmental sample
  DOMAIN (6)...(306): Pyridine nucleotide-disulphide oxidoreductase
  DOMAIN (6)...(322): FAD dependent oxidoreductase
  DOMAIN (168)...(260): Pyridine nucleotide-disulphide oxidoreductase
  DOMAIN (337)...(447): Pyridine nucleotide-disulphide oxidoreductase, dimerisation domain
  SITE (39)...(49): Pyridine nucleotide-disulphide oxidoreductases class-I active site. Prosite id = PS00076
  SITE (245)...(257): EF-hand calcium-binding domain. Prosite id = PS00018
MTDSFDLIVLGAGSGGLATAFRAARHGARVALLESGVLGGTCVNVGCVPKKAMWYAAQMAEMQQLAVDYGFASRPGPLDWPTFVAHRQAYIDRIHAGYRKRLAESGVELIAARGALDGPHAVKAGGRSLQAPHIVVATGARPRRLDTPGFELGIVSDGFFDLRASPRRVAIVGGGYISVELGGVLRALGAEVEIFARGHLMRGFDAHLSLALGEAMRELGIRIHYQCDIEAARREKDGVVLDCSAGDRMGPYDVLLWAVGRVPNSDGIGLEAQGVELDARGHVLVDARQNTAAAGIYAIGDVTDRLALTPVAIAAGRRLADRVFGGDDDAFLDYENIPSVVFSHPPLAGVGLTEQAARELHGDAVRVFTSRFTPMQLALSAHPQPMLMKLVCAGDEQRVVGVHMLGPGADEILQGFAVAVKMGARKADLDATVAIHPTSAEELVLMG

SEQ ID NO: 655 - DNA, 1284 bp, Unknown
  Obtained from environmental sample
atgagcgcattggcgccatgccgtcaggggagtgagttcatggctcgaacggacgcgatcgtgctcggggccggcattgtcggcacatcgaccgcgctgcatctcgccaagcgcgggctgtcggtcgcgctcatcgacaggggaggcccgggggaggggacgagctacggcaacaccggcgtcatcgtgggggcgagcaacctgccgacgccgttcccgcgcaagctggccgcactggtccgcatcgccctgaagaaggcgccggaggcgaactatcactggtcgcatctgccgaaggtcgggccctggctgctggcctactggcgcgaatcgacccccgcacggatcgaccgcgcggcgcggctgctgcagccgatcatggcgcgggccttgcccgagcacgaggcgctgatcgcggaatcgggtgcgcagcgcttcctgcgcaagaccggttggctcatcctctaccgcaacgaggcggcgttcgacggcgcaaaggcgcaactcgactttgcggccgagatgggatcgaggccgcaggtgctcgacaccgaggcgacgcgcgcgctcgaaccgagcctcgccccggtttttcgccgcgccgtctattgggacgatgtcgcgagcctctcgaacccgctcggcgtgacgcgcgccttcgccgagcgcttcaaggcactcggcggaatcgtcctgcagggcgatgcgcgcacgctgcaccgcgcggaggggcgctggcgtctcgacaccgacgagggccatgtggattcgccaaatgtggtggtcacgctcggtccctgggcgccggacctgctcgagccgctcggcatcaagctgccgctcggcatcaagcgcggctatcaccgtcatttccggccggccgggaacgcgtcgctgtcccggccgatcatcgataccgagaacggctatgcgatcacgcccatggagcagggcatccggctcaccaccggcgcggagtttgcgaaccgcgacgccccggcgacgccggtgcagttcgagcggctgatgccggccgccaagcagctgtttccgctgggcgagccggtcgagcccgagccctggctaggcaggcgcccctgctttcccgactccatgcccgtcatcggcccggcacccggtcaacccgggctctggctcggcttcggccacggccattggggcctgacactcgggccggcgaccgggcgtctggtcgcggaactggtcaccggccagaccccgttctgcgatccggcgccttaccgggcagagcggttcatgtga

SEQ ID NO: 656 - protein, 427 aa, Unknown
  Obtained from environmental sample
  DOMAIN (18)...(408): FAD dependent oxidoreductase
  SITE (300)...(303): N-glycosylation site. Prosite id = PS00001
MSALAPCRQGSEFMARTDAIVLGAGIVGTSTALHLAKRGLSVALIDRGGPGEGTSYGNTGVIVGASNLPTPFPRKLAALVRIALKKAPEANYHWSHLPKVGPWLLAYWRESTPARIDRAARLLQPIMARALPEHEALIAESGAQRFLRKTGWLILYRNEAAFDGAKAQLDFAAEMGSRPQVLDTEATRALEPSLAPVFRRAVYWDDVASLSNPLGVTRAFAERFKALGGIVLQGDARTLHRAEGRWRLDTDEGHVDSPNVVVTLGPWAPDLLEPLGIKLPLGIKRGYHRHFRPAGNASLSRPIIDTENGYAITPMEQGIRLTTGAEFANRDAPATPVQFERLMPAAKQLFPLGEPVEPEPWLGRRPCFPDSMPVIGPAPGQPGLWLGFGHGHWGLTLGPATGRLVAELVTGQTPFCDPAPYRAERFM

SEQ ID NO: 657 - DNA, 1008 bp, Unknown
  Obtained from environmental sample
atgcaaaatcatacccaagaaactaaacccgtaattactgtgctgggttgtggggtaagcggccttaccacggccattctgctgttggagagtggctatccggtgcagatctgggccagggatttgccgccgcgcaccacctccaatattgctgcagcggtctggtatccctacaaagtggcgccggaaggcaaggtagccgaatggggcgaacgcagttatgccattttctgcgaactggccgaggtggaggggactggcatcaaaattttgccggggatcgagcttttccgccaccccaccctcgacccaatctggtcgcgctttgtacgcaattatcgccgcgtacagccccacgaattacctgccggctaccaggatggctattttttcgactcgccggtgattgatacgggaatttacatcgcttatctggtgcagcgggtgcatgaactgggcggccagatcagccagcgcgaaataggttcgctggcggaagcttttcaggatagcaagctggtgattaattgcaccgggttaggctcgcggacgctactgggcgacaaagaaatctatccgattcgcggccagattatgcgggtaactcgtgacgggctaaaggatttcttcgttacctccgataacgagggcgtcgccaattatgtggtgccgcgctccaacgattgcatcctgggcggtaccgccgatgtaggggaatggtcgctggagccaaacgaggccaccgccgccaaaatttgggaggattgccgccagttagtgccggaagtagccaatacgcaaatccttgaacacctggtcggcctgcgaccggctcgcaaggaagtccgcctggaagccgaagtattgcctgatgccagcgttgtcatccataactacggacatggaggcgcgggcgtaaccatttcctggggttgcgctgagcaagttctgagtttagtccgggtttttagcccccaaggacttggcctcgaacagagtaaagtttaa

SEQ ID NO: 658 - protein, 335 aa, Unknown
  Obtained from environmental sample
  DOMAIN (11)...(319): FAD dependent oxidoreductase
  SITE (3)...(6): N-glycosylation site. Prosite id = PS00001
  SITE (178)...(181): N-glycosylation site. Prosite id = PS00001
  SITE (299)...(317): D-amino acid oxidases signature. Prosite id = PS00677
MQNHTQETKPVITVLGCGVSGLTTAILLLESGYPVQIWARDLPPRTTSNIAAAVWYPYKVAPEGKVAEWGERSYAIFCELAEVEGTGIKILPGIELFRHPTLDPIWSRFVRNYRRVQPHELPAGYQDGYFFDSPVIDTGIYIAYLVQRVHELGGQISQREIGSLAEAFQDSKLVINCTGLGSRTLLGDKEIYPIRGQIMRVTRDGLKDFFVTSDNEGVANYVVPRSNDCILGGTADVGEWSLEPNEATAAKIWEDCRQLVPEVANTQILEHLVGLRPARKEVRLEAEVLPDASVVIHNYGHGGAGVTISWGCAEQVLSLVRVFSPQGLGLEQSKV

SEQ ID NO: 659 - DNA, 1245 bp, Unknown
  Obtained from environmental sample
atgcgcgtaatagtgctgggggccggcgtgatcggcgtgacttcggcgtggtatttggcccaagccgggcacgaagtgacggtggtggatcgccaaccggatgccggccttgaaactagctttgccaacggtagccaaatttccgtgtgccatgcggagccctgggccaatccggcagtgttttccaaattgttgcgttggttggggagagaggacgcaccgctgttgtggcgttttcggtgggacccagcccaatgggcctggggactgcgcttcctggctcaatgcggccccactcgaacccggcagaacattgaagcgctggttgccctcggcttgcacagccgggccagcttgcagtcactccgtacggagttgaatctgcaatacgaccagttggaaaagggcatactgcatttctataccgatgcccgtgaatttgagcatgcacgtccccaggcagaactcatgacccaactgggctgcccccgtcgggtagtttccacggctgaatgtctggccctagagcccgccctgcaacacattgggtcgaagattgtcggtggtacctacaccccggatgacgagtcgggcgatgcacgaaagttcacccagcagctggctcagcgctgtgcctctgcgggcatcgtcttccgttatgggagcacgattgccgccatccaggccgaagccggaaaaatcagcggggttcgcttggccggcagcgaggtgctgacggcagatgcctatgtattggcgctgggcagctatgcaccactattgacggcccccttgggcatgtccttgccggtgtatccggcgaagggttactccatcactattcccttggccgaggggagtggggcgccgaccgtcagcctcaccgacgacggttacaagctggtgtattcccgccttgggcagcgcctgcgggtagcggggacggcagagttttgtggttacgacaccagcctcaaccgggcaaggctggaggccttgaaggtacggacgaaggaagtgtttcccaccttgaaggcagccggcgaaatagaggagtgggccggcttgcggcccgctacgccggggaacgtgcctttgattggcgccagtcgctatcccaatctcttcctgaatgtcggacacggcaccctgggatggactctggcctgcggttcggggcaattgttggctgacttggttagcgggcgggaaccggctattgacccggttcgttatcggccctga

SEQ ID NO: 660 - protein, 414 aa, Unknown
  Obtained from environmental sample
  DOMAIN (2)...(399): FAD dependent oxidoreductase
  SITE (43)...(46): N-glycosylation site. Prosite id = PS00001
MRVIVLGAGVIGVTSAWYLAQAGHEVTVVDRQPDAGLETSFANGSQISVCHAEPWANPAVFSKLLRWLGREDAPLLWRFRWDPAQWAWGLRFLAQCGPTRTRQNIEALVALGLHSRASLQSLRTELNLQYDQLEKGILHFYTDAREFEHARPQAELMTQLGCPRRVVSTAECLALEPALQHIGSKIVGGTYTPDDESGDARKFTQQLAQRCASAGIVFRYGSTIAAIQAEAGKISGVRLAGSEVLTADAYVLALGSYAPLLTAPLGMSLPVYPAKGYSITIPLAEGSGAPTVSLTDDGYKLVYSRLGQRLRVAGTAEFCGYDTSLNRARLEALKVRTKEVFPTLKAAGEIEEWAGLRPATPGNVPLIGASRYPNLFLNVGHGTLGWTLACGSGQLLADLVSGREPAIDPVRYRP

SEQ ID NO: 661 - DNA, 1188 bp, Unknown
  Obtained from environmental sample
atgaagcgttcggttcagcggcgtcaggtagtgctcggaagcggtgcagccctattggtcggagcgctggacggctgcgcaggctctattcgcaccctgcagtcccctgcaccggccggccccaccttacagctcccacccctgcacgcgactacagatcggataactgtcatcaccgtctgtacgcggccgtttcgcccacagggtccccggctcgaagtggagcaagtcggacagaaggtcgtcgttcacaactacggccatggtggcagcggctggtcgctgtcgtggggatcgagcacactcgccactgagaaggccctcgcgaccggcgagcgcgacatcggagtcatcggctgcggagccctggggatgacctctgccctgctcctgcaacgcgccggcgcgcgggtcaccatctacgccaaagacttgccacccaacgttcgctcgtcgttggcaacgggtgtctttacgcccgactcgcggatctgcttcgaaccaaacgcaactgcggccttcaagcagcaatgggcgaagatggcgcgaacgtcgtaccaaacttatcagacactgctgggtcttccgggagacccggtcgagttcatcgacaactatgcggtggtcgacgaggagcggcctcccgcacatacacctgctgcacgagactcccgtccggcctttgcggagctccagcgtgagttgctcccggatctgttgccagtggaggagcgattcgcacctggtagtcacccgttcgggagaaggtacgcccggcgggcgcccatgatgatgttcaatcttgccgcctactctcggatgctcctatccgacttcctgcagaacggcgggcgcatcgtcatcgacgagtttcattcaccggcagacttcactcgactgcgggagaagacgctgatcaatgcaacgggctatggcgcacgcgctctgttcaacgatcagtccataacgccggtgcgaggacaactcgcacgcatgattccccaaccggaagtacgctacgggctcgagtatcggaatgtctatttcgtgccgcgtcgcgatggtctcgtatttcaggttggtggcgaagatgactactacggcttcggcgacgacacggctgcacccgatcgggccgaggcggagttggcagtcaagacgatcgctactctcttcagccccacctga

SEQ ID NO: 662 - protein, 395 aa, Unknown
  Obtained from environmental sample
  DOMAIN (114)...(391): FAD dependent oxidoreductase
  SITE (171)...(174): N-glycosylation site. Prosite id = PS00001
  SITE (311)...(314): N-glycosylation site. Prosite id = PS00001
MKRSVQRRQVVLGSGAALLVGALDGCAGSIRTLQSPAPAGPTLQLPPLHATTDRITVITVCTRPFRPQGPRLEVEQVGQKVVVHNYGHGGSGWSLSWGSSTLATEKALATGERDIGVIGCGALGMTSALLLQRAGARVTIYAKDLPPNVRSSLATGVFTPDSRICFEPNATAAFKQQWAKMARTSYQTYQTLLGLPGDPVEFIDNYAVVDEERPPAHTPAARDSRPAFAELQRELLPDLLPVEERFAPGSHPFGRRYARRAPMMMFNLAAYSRMLLSDFLQNGGRIVIDEFHSPADFTRLREKTLINATGYGARALFNDQSITPVRGQLARMIPQPEVRYGLEYRNVYFVPRRDGLVFQVGGEDDYYGFGDDTAAPDRAEAELAVKTIATLFSPT

SEQ ID NO: 663 - DNA, 1245 bp, Unknown
  Obtained from environmental sample
atggcgcggacggatgcaatcgttctgggtgccggcattgtcggcacgtcggttgcgctgcaccttgcgaaacgcgggatctcggttgcgctgatcgacaagcgggggccgggcgaggagacgagctacggcaacaccggcgtgatcgtcggcgccagcgtgtttccgaccgcgtttccgcgcaacctgaaaaagatcatccaggtcgcgctcaagcgcacgcccgaagcgaactatcactggggcgatctcctcaagatcgcgccatggctgatctcctattacggcttctcgacccctgagaaactgaaggacagtgcgctcaagctgcgtccgctgatgagccgcgcgcttgccgaacacaaactcctgatcgaggaatccggtgcgcagaaatatctgcgcgagaccggctggatgacgctttatcgcagcgacaagtcattcgaggcgatgaaaccgcaactcgaattcggcgccgagatcggtgttgcggcaaatccgctcgataccgaaggggcgttggcgctggagccgtcgctcgcgccggtgtttcgccatgcgctgctgtggcccgacgtcgcctcactctcgaacccactgatggtgacgcgcgcttacgcggcgcggttctcggcgctcggcggcgtgttcgtgaatggcgatgcgcgctcgctgcatcgctccgacggccgctggcgcgtcgacaccgagaacgggccggtcgattcgtccgaagtcgtcgtcgcgctcgggccgtggtcgaccgatgtgctggagccgctcggcatcaaggtgccgctcgggatcaagcgcggctatcaccgccatttcaacgcgaagggaaatgcctcgctctcgcgtccgatcatcgataccgaaatcggctatgcgctgaccccgatggagcagggtatccgcctgaccaccggcgcggagttcgcggcgcgcgacgcggcgccgaccccggtgcaattcgaccggttgatgccgagcgcaaaggagctgtttccgctcggcgagccgaacgaggccgagccgtggctggggcggcgtccgaacacgccggactcattgccgttcctcggccgcgctccggggcagcaggggctgtggctcgcgttcggtcacggccactggggagtgacgatgggcgccgtgaccggtcggctgatagccgaactggtgaccggcgcgacgccgttcgccgatccggcgccgtatcgggccgagcggttcatgtag

SEQ ID NO: 664 - protein, 414 aa, Unknown
  Obtained from environmental sample
  DOMAIN (5)...(395): FAD dependent oxidoreductase
  SITE (287)...(290): N-glycosylation site. Prosite id = PS00001
MARTDAIVLGAGIVGTSVALHLAKRGISVALIDKRGPGEETSYGNTGVIVGASVFPTAFPRNLKKIIQVALKRTPEANYHWGDLLKIAPWLISYYGFSTPEKLKDSALKLRPLMSRALAEHKLLIEESGAQKYLRETGWMTLYRSDKSFEAMKPQLEFGAEIGVAANPLDTEGALALEPSLAPVFRHALLWPDVASLSNPLMVTRAYAARFSALGGVFVNGDARSLHRSDGRWRVDTENGPVDSSEVVVALGPWSTDVLEPLGIKVPLGIKRGYHRHFNAKGNASLSRPIIDTEIGYALTPMEQGIRLTTGAEFAARDAAPTPVQFDRLMPSAKELFPLGEPNEAEPWLGRRPNTPDSLPFLGRAPGQQGLWLAFGHGHWGVTMGAVTGRLIAELVTGATPFADPAPYRAERFM

SEQ ID NO: 665 - DNA, 1263 bp, Unknown
  Obtained from environmental sample
atgaagtcggtcgcaatcatcggcgccggtctcgccgggctcgctaccgcctattggctccggcgccacggcgtgtcggtgacggtcgtggacaagcgccaggctccgggcgaaggcaccagctttgccaacggcggcatgctgaccccgagccaggccaatccgtggaacagccccgacacgtccgcccatttcctcggctggatcggacgcaaggaatcgccgctggcgatccggccatcggctctgccgggcctcgcgggatggggtgtgcgcttcctgctcgaatcgcttccgagccgttatcgacgcaacacggcgagcaacctcgcgctcggcagctacagcctggacatgcacaaggcgctggttgccgagaccaatctgcaattcgatcgtgctcgcgtgggcacgctgcagatcttccgctcgcaacccgcgttcgacgaaggcatgcgcgccgccggattcttgcgcgaccgcggcatcgccgtccggccgctcgacgctgcggcgacgctcgagctcgcgcccaccctgcgggagagccgcctgcgactcgccggcggcatccacttcccggaggacgaaagcggcgatgctcttctgttctgccgcgcactggcccgctacctgcaagcggacggcgtgacgctcgtatatggggccgacatcacggggatcgccgcggaagggcccacggtgcgcgccctggtatcgtcgcacgatcgcatcgacgccgacgccttcgtggtcgcagcgggacccggctcgaatgccctgctgcgccactgcggtattcattcacccatctatcccgtgaagggctactcgctcacctgcgacatcgcggggctgagctcggtaccggcgattccgctcgtcgacatggggcgcaagatcgcgctcacgccgctcggagaccggctccgtatcgccggcaccgcggaattcggcggttacgacaccaacctcgacgaacgacggctcggcagcattcttcgaaatgcctgcgaaatcatgccggcgctccgcaatgtcccggccgcgaagttttcgcggtgggcgggcctgcgcccagtcacgccgaccggattcccgatgctcggccgcacccggctcgacaacctgttcaccaatgccggccacggcccgctcggctggaccttcgcggccggtactggaaagatcgtcgccgatatcatcgcgaccggaacccacgacttggcaacggtcaccgccgtcggaggcagaatcccatga

SEQ ID NO: 666 - protein, 420 aa, Unknown
  Obtained from environmental sample
  SIGNAL (1)...(17)
  DOMAIN (3)...(401): FAD dependent oxidoreductase
MKSVAIIGAGLAGLATAYWLRRHGVSVTVVDKRQAPGEGTSFANGGMLTPSQANPWNSPDTSAHFLGWIGRKESPLAIRPSALPGLAGWGVRFLLESLPSRYRRNTASNLALGSYSLDMHKALVAETNLQFDRARVGTLQIFRSQPAFDEGMRAAGFLRDRGIAVRPLDAAATLELAPTLRESRLRLAGGIHFPEDESGDALLFCRALARYLQADGVTLVYGADITGIAAEGPTVRALVSSHDRIDADAFVVAAGPGSNALLRHCGIHSPIYPVKGYSLTCDIAGLSSVPAIPLVDMGRKIALTPLGDRLRIAGTAEFGGYDTNLDERRLGSILRNACEIMPALRNVPAAKFSRWAGLRPVTPTGFPMLGRTRLDNLFTNAGHGPLGWTFAAGTGKIVADIIATGTHDLATVTAVGGRIP

SEQ ID NO: 667 - DNA, 1113 bp, Unknown
  Obtained from environmental sample
ttggacggaaccgacctcgataggcgcgccgcgctaggtctcggcttgggagctgcggcgggtctcgttacgcgttccgaaccggcgagagcgttcgactccgtcacggcgctaccccggctcaaggtctcgcccgaactgatcctgcgccaagtcgccgggttgcgcccgttcaggccgtcgggcttcctcgtcaagagcgagccgctaggcagcaaaatcatcgtgcacaattatgggcatggcggatgcggtgtcaccctgtcctggggaacggccgatatggcggccaggcttgctctcgccacgccgcaccgaaaggctgccgttatcggctgcggagtcatcgggcttaccacggcgcggctgctacaggaccgcggtttcgacgtggccatctatgccgccgagctgccgcccgacaccacatcggatgtggccgccggcgccttcggcgtcacctcgctggtcgacgatcagcatcgcacgccggaaatcacgggcttgattcaggaggcggtgcgctttgcctacagatatttcgaggctctaatcggcggccgatacggcgtgcgctggatggacttctacatgctgagcgcagaaccggtggagttgccttgggagttctcaattacgcccgagctttttcccctcacgaaattcggtccgggcgagcatccttttccctcgccttacgccggcaggttcagaaccatgatcgccgaaaccgacatattcttgccggcgctcatggacgacgtacgtaaaggcggcgccaccatcgaagtccgcaaattcaccgacctttccagcttgcaatcgctcgacgcgccgctgatcgtcaactgcacgggtctcggcgccaaggccctgttcggcgatccggtgcttacgccggtcaaggggcagctcaccgtgttgcgaccccagcccgatgtgacttacgcctatctcgacggcgtgctcgatttctacatgttctcgcgcagcgacgggatcgtgctgggcgggagtcatggcgaaggggtctggtcgacggacatcgacggcctccgcgcggcgcaaatcctcgagggccacgcgctcatcgccggcggcatgcggtcatga

SEQ ID NO: 668 - protein, 370 aa, Unknown
  Obtained from environmental sample
  DOMAIN (107)...(369): FAD dependent oxidoreductase
  SITE (76)...(94): D-amino acid oxidases signature. Prosite id = PS00677
  SITE (287)...(290): N-glycosylation site. Prosite id = PS00001
MDGTDLDRRAALGLGLGAAAGLVTRSEPARAFDSVTALPRLKVSPELILRQVAGLRPFRPSGFLVKSEPLGSKIIVHNYGHGGCGVTLSWGTADMAARLALATPHRKAAVIGCGVIGLTTARLLQDRGFDVAIYAAELPPDTTSDVAAGAFGVTSLVDDQHRTPEITGLIQEAVRFAYRYFEALIGGRYGVRWMDFYMLSAEPVELPWEFSITPELFPLTKFGPGEHPFPSPYAGRFRTMIAETDIFLPALMDDVRKGGATIEVRKFTDLSSLQSLDAPLIVNCTGLGAKALFGDPVLTPVKGQLTVLRPQPDVTYAYLDGVLDFYMFSRSDGIVLGGSHGEGVWSTDIDGLRAAQILEGHALIAGGMRS

SEQ ID NO: 669 - DNA, 1260 bp, Unknown
  Obtained from environmental sample
atggctcgaacggacgctatcgtgctgggcgccggtatcataggcacctcgatcgcgctgcatctggtcaagcgcgggctgtccgtcgcgctggtggaccggcgcggaccgggcgaggagacctcctacggcaattccggtgtgatcgagggcaacacggtcttcccgcacccgttcccgaccactctgtcgtcgctgctcaagatcgcgctcaagcaggcgccggaagcgaactatcacatcgcggatttgccgcagctcgcgccatggctcctggcctaccgtcacaacacccagcttgccggcagcctcgcctttgccgagtcgatgcggccgctgttcggccgggcgctcgccgagcacgaggccctgatgacggaatccggcgcgacgcggtatctgcgcaaggatggctggctcaagctctaccgcagcgaaggcccggacgcccggcagtcggccgagctcgagcttgcctcgaagttcggtctgccgttccggatgctcgacaccgaaggtgcgcgcgcgctcgagccgtcgctcgcgccggtgttccgccgcgcggtgcattggccgaacgccgcgagcgtctccaatccgctcgccgtcaccaaggcctatgtggcgcagtatgtcctgctcggcggcctggtgctcaagggcgacgcgcgcacgctgcatcgctccggcaccggctggcgcatcgacaccgaagaaggcgcgctcgacaccaaggacgtggtggtggcgctcggaccctgggcgcccgatgtgctggagcctctgggagtccgtctgccgctcgcggtcaagcgcggctatcaccgccacttccggccggtcggcaacgccggcctgacgcgccccgtggtcgacaacgacaacggctatctgctggcgccgatggagcagggcatccggctcaccaccggcgccgaattcgcccgccgcgatgcgccggcgacgccggtgcagttcgaccggctgctgccggccgccagggccctgttcccgctcggcgagcccgccgaggccacgacctggatgggttcgcgcccgagctttgccgattccatgccggtgatcgggcaggctccgggacagaccggactgtggctcgcctatggccatgcccattggggcctgacgctcggtccggtgaccgggcgcctcgtcgccgacctggtgacgggctcagcgccgttctgcgatcccaagccctacgcggcctcccgtttcgggaacgatcgttcggcatga

SEQ ID NO: 670 - protein, 419 aa, Unknown
  Obtained from environmental sample
  DOMAIN (5)...(395): FAD dependent oxidoreductase
MARTDAIVLGAGIIGTSIALHLVKRGLSVALVDRRGPGEETSYGNSGVIEGNTVFPHPFPTTLSSLLKIALKQAPEANYHIADLPQLAPWLLAYRHNTQLAGSLAFAESMRPLFGRALAEHEALMTESGATRYLRKDGWLKLYRSEGPDARQSAELELASKFGLPFRMLDTEGARALEPSLAPVFRRAVHWPNAASVSNPLAVTKAYVAQYVLLGGLVLKGDARTLHRSGTGWRIDTEEGALDTKDVVVALGPWAPDVLEPLGVRLPLAVKRGYHRHFRPVGNAGLTRPVVDNDNGYLLAPMEQGIRLTTGAEFARRDAPATPVQFDRLLPAARALFPLGEPAEATTWMGSRPSFADSMPVIGQAPGQTGLWLAYGHAHWGLTLGPVTGRLVADLVTGSAPFCDPKPYAASRFGNDRSA

SEQ ID NO: 671 - DNA, 1242 bp, Unknown
  Obtained from environmental sample
atggatttcgacgtaatcgtattgggcgccggcattgtcggcgtgtcggccgcgctgcatctgcaggatcgcggacgccgcgtcgcgctggtcgatcggcgcgggcccggtgaggaaaccagtttcggcaacgcggggttgatcgagagttcgtcgatcgtgccgtacggttttccgcgccggctcggcacgctactgcgctacgcgcgcaatcaatcgaccgatctctactgggactaccgggcgcttcccgcattcgccggatggctggggcgtttctggtgggagtcatcacccgagcggctggcggcagcggcgcgcgatatgttgccgttgatccgccagagcgtcgccgaacacgatgcgctgatcgcgcgcgcgggcctcgaatcgctcgcgcacgacggcggatggatcgaagcgtttcgcacgcaaagcgaactggatcatcagacggcggcggccgagtccgccgtgcgcgacctcggtctgcgcgtcgtgcctctcgatgcggccgcgttgtgcgcgaaagaaccgagcatcaatcgcggcttttgcggtgcgttgcactggcaggacccgaagagcatctccgatccgggcgcgctgacgaaaggctatgcgcgtctcttcgaacagtccggcggcacgttgctgaccggcgacgccgcgacgctgcgcgcgcgaggcgacgggtggaccgtgcagagcagcgtcggcgaaatcagcgcgagggaagtggtggtcgcgctcggaccttggtcggacacggtgttcgcaccactcggctatcgcattccgctgcgcgcgaaacgcggctatcacatgcactatcggcccacgcagacggtgttgtccgtccccgtggtcgacaccgaggaaggctacgtgattgcgccgatgcgaggcggcttgcggctcaccaccggcgttgaaattgcgcgtcgcgaggcagcgcccacggggattcaactcgaacgcgccgaacgtatcgccaaaccgctgttcggtttgggcgagcgtgtagacgaggcgccgtggctcgggctgcgtccgtgcacgcccgacatgcggccggtgatcggacgcgcgccccgccatcgcgggctgtggttttcgttcggacataaccatcacggcttgacgctcggacccgtcaccggacgtttgctcgcggaaatgatgacgggcgcgactccgttcatcgacgtgcggccgtttcgtccggagcgattccggtag

SEQ ID NO: 672 - protein, 413 aa, Unknown
  Obtained from environmental sample
  DOMAIN (4)...(394): FAD dependent oxidoreductase
  SITE (72)...(75): N-glycosylation site. Prosite id = PS00001
MDFDVIVLGAGIVGVSAALHLQDRGRRVALVDRRGPGEETSFGNAGLIESSSIVPYGFPRRLGTLLRYARNQSTDLYWDYRALPAFAGWLGRFWWESSPERLAAAARDMLPLIRQSVAEHDALIARAGLESLAHDGGWIEAFRTQSELDHQTAAAESAVRDLGLRVVPLDAAALCAKEPSINRGFCGALHWQDPKSISDPGALTKGYARLFEQSGGTLLTGDAATLRARGDGWTVQSSVGEISAREVVVALGPWSDTVFAPLGYRIPLRAKRGYHMHYRPTQTVLSVPVVDTEEGYVIAPMRGGLRLTTGVEIARREAAPTGIQLERAERIAKPLFGLGERVDEAPWLGLRPCTPDMRPVIGRAPRHRGLWFSFGHNHHGLTLGPVTGRLLAEMMTGATPFIDVRPFRPERFR

SEQ ID NO: 673 - DNA, 1242 bp, Unknown
  Obtained from environmental sample
atggatttcgacgtaatcgtattgggcgccggcattgtcggcgtgtcggccgcgctgcatctgcaggatcgcggacgccgcgtcgcgctggtcgatcggcgcgggcccggtgaggaaaccagtttcggcaacgcggggttgatcgagagttcgtcgatcgtgccgtacggttttccgcgccggctcggcacgctactgcgctacgcgcgcaatcaatcgaccgatctctactgggactaccgggcgcttcccgcattcgccggatggctggggcgtttctggtgggagtcatcacccgagcggctggcggcagcggcgcgcgatatgttgccgttgatccgccagagcgtcgccgaacacgatgcgctgatcgcgcgcgcgggcctcgaatcgctcgcgcacgacggcggatggatcgaagcgtttcgcacgcaaagcgaactggatcatcagacggcggcggccgagtccgccgtgcgcgacctcggtctgcgcgtcgtgcctctcgacgcggccgcgttgtgcgcgaaagaaccgagcatcaatcgcggcttttgcggtgcgttgcactggcaggacccgaagagcatctccgatccgggcgcgctgacgaaaggctatgcgcgtctcttcgaacagtccggcggcacgttgctgaccggcgacgccgcgacgctgcgcgcgcgaggcgacgggtggaccgtgcagagcagcgtcggcgaaatcagcgcgagggaagtggtggtcgcgctcggaccttggtcggacacggcgttcgcaccactcggctatcgcattccgctgcgcgcgaaacgcggctatcacatgcactatcggcccacgcagacggtgttgtccgtccccgtggtcgacaccgaggaaggctacgtgattgcgccgatgcgaggcggcttgcggctcaccaccggcgttgaaattgcgcgtcgcgaggcagcgcccacggggattcaactcgaacgcgccgaacgtatcgccaaaccgctgttcggtttgggcgagcgtgtagacgaggcgccgtggctcgggctgcgtccgtgcacgcccgacatgcggccggtgatcggacgcgcgccccgccatcgcgggctgtggttttcgttcggacataaccatcacggcttgacgctcggacccgtcaccggacgtttgctcgcggaaatgatgacgggcgcgactccgttcatcgacgtgcggccgtttcgtccggagcgattccggtag

SEQ ID NO: 674 - protein, 413 aa, Unknown
  Obtained from environmental sample
  DOMAIN (4)...(394): FAD dependent oxidoreductase
  SITE (72)...(75): N-glycosylation site. Prosite id = PS00001
MDFDVIVLGAGIVGVSAALHLQDRGRRVALVDRRGPGEETSFGNAGLIESSSIVPYGFPRRLGTLLRYARNQSTDLYWDYRALPAFAGWLGRFWWESSPERLAAAARDMLPLIRQSVAEHDALIARAGLESLAHDGGWIEAFRTQSELDHQTAAAESAVRDLGLRVVPLDAAALCAKEPSINRGFCGALHWQDPKSISDPGALTKGYARLFEQSGGTLLTGDAATLRARGDGWTVQSSVGEISAREVVVALGPWSDTAFAPLGYRIPLRAKRGYHMHYRPTQTVLSVPVVDTEEGYVIAPMRGGLRLTTGVEIARREAAPTGIQLERAERIAKPLFGLGERVDEAPWLGLRPCTPDMRPVIGRAPRHRGLWFSFGHNHHGLTLGPVTGRLLAEMMTGATPFIDVRPFRPERFR

SEQ ID NO: 675 - DNA, 1242 bp, Unknown; identical to SEQ ID NO: 673
  Obtained from environmental sample

SEQ ID NO: 676 - protein, 413 aa, Unknown; identical to SEQ ID NO: 674
  Obtained from environmental sample
  DOMAIN (4)...(394): FAD dependent oxidoreductase
  SITE (72)...(75): N-glycosylation site. Prosite id = PS00001

SEQ ID NO: 677 - DNA, 909 bp, Unknown
  Obtained from environmental sample
atgcacgaggtgacggtggtcggcgcgggcgtggtggggctgaccaccgcgctcgtcctccaggagtcgggacaccgggtcagggtcgtcgccgccgagcgtccggagcagacgacctcggccgccgccggtgcggtctggtatcccttctcggtcgggcctccggaggccgtgaaccgctgggcccggaccacccgggactggctgctcaggctgcatcgcactgtgccgtccgcgggcgtggacgtgatcaccgtccgggagtgcgccgccgacgcgcggcgtccctggtgggcagacgtggtcgagggccggctcgtcgagggaccgcagccgaccggggcacgacttgcctgggagttcgaggcgccccgcgtggagccggcgctgcatctctcctggctcgagtcgcagctggagcagccgatcgagattgcccgggtcgagcggctggaggacgtgcctggcgacctggtggtgaactgcactggcatcggggcacgacggctgggcggtgacggcagcctgcgggcgctgcttggccagaccgtggtggtggccccgggtgaggtcgacatgcagtgcatgttcggagacgagcgggacctctcggtgatgctctacgtgattccccgccgggccgaggtggtcctcggcgggtgcgctctgccgttcgacggcgacgtttcgcctccgccagacccggcgcttcgcgcggcgatcctcgcgcgggtgcgtgcggcggggttccggcatggacccgtgctccgcgacgcggtggggctccggccggtccggcccgaggtccgcgtcgagcgggtcgggcgcgtcattcaccactacgggcacggcggagctggctacactctggcccgcggctcggcagcgcaggtcatcgactcgatctga

SEQ ID NO: 678 - protein, 302 aa, Unknown
  Obtained from environmental sample
  DOMAIN (3)...(301): FAD dependent oxidoreductase
  SITE (163)...(166): N-glycosylation site. Prosite id = PS00001
  SITE (281)...(299): D-amino acid oxidases signature. Prosite id = PS00677
MHEVTVVGAGVVGLTTALVLQESGHRVRVVAAERPEQTTSAAAGAVWYPFSVGPPEAVNRWARTTRDWLLRLHRTVPSAGVDVITVRECAADARRPWWADVVEGRLVEGPQPTGARLAWEFEAPRVEPALHLSWLESQLEQPIEIARVERLEDVPGDLVVNCTGIGARRLGGDGSLRALLGQTVVVAPGEVDMQCMFGDERDLSVMLYVIPRRAEVVLGGCALPFDGDVSPPPDPALRAAILARVRAAGFRHGPVLRDAVGLRPVRPEVRVERVGRVIHHYGHGGAGYTLARGSAAQVIDSI

SEQ ID NO: 679 - DNA, 1161 bp, Unknown
  Obtained from environmental sample
atgatgatggatgcacaggttttcgatttcgccgtggtcggcgcgggcatggccggcgcctcggtggcctaccggctggcgcgttccggcgcctcggtgctggtgctcgagcgcgaggcgcagccgggctaccactccacgggccgttcggccgccatgttcatggaaagctacggcaccgagcagatccgggcgctgacacgcgccagccgcgccttctacagcgcgccgcccgaggggttctgcacgcatgggctgctgcagccgcgcagcgtgctctacgtgggcaccgaaggacaggagtccctgctggacgaggccctggccatgtaccgccgcgacggcctgcgcgccgagcgcataggccccgaacaggcccatgccctggtgccctgcctggatgcgcggcagctcgtgggggccgtgcatgacatggacgccatggacatcgacgtggccgagctgcaccagggctttttgcgcggcatggcgcgcgcgggtgcccggctgcgctgcgaggccgatctcgccggcgcccggcgcgatgacgcggcccatggccagggggtctggacgctgaccctgcgcgacggcagccgcctgcgcgcccgcgccgtggtcaatgccgcgggggcctgggccgatgccgtggcccgcctgtgcggggcccggcccctgggcatagaaccgcggcgccgctcggccttcaccttcgccgcgcccgagggactgcccatccatgactggcccgccgtgatcggcgtggacgagagcttttacttcaagcccgacgcgggccaactgctggggtcgccggccaacgccgatcccgttccggcccacgacgtggccgccgaggagctggacgtggccacgggcatccaccgcatagagtcgctgaccagcctgcgcatacgccggccccgccatgtctgggccgggctgcgcagcttcgcgcccgacgatgacttcgtgatcggctgggacacggggtgcgacggctttttctggctggcggggcagggcggctacggcatacagacggccgccggcgcctcggccgccgccagcgcgctgctgctgggccgggagctgcccgaggagctcagggcccagggcgtcgatgcccggcgcctgagccccgcgcgcttcgccgcctga

SEQ ID NO: 680 - protein, 386 aa, Unknown
  Obtained from environmental sample
  DOMAIN (9)...(359): FAD dependent oxidoreductase
MMMDAQVFDFAVVGAGMAGASVAYRLARSGASVLVLEREAQPGYHSTGRSAAMFMESYGTEQIRALTRASRAFYSAPPEGFCTHGLLQPRSVLYVGTEGQESLLDEALAMYRRDGLRAERIGPEQAHALVPCLDARQLVGAVHDMDAMDIDVAELHQGFLRGMARAGARLRCEADLAGARRDDAAHGQGVWTLTLRDGSRLRARAVVNAAGAWADAVARLCGARPLGIEPRRRSAFTFAAPEGLPIHDWPAVIGVDESFYFKPDAGQLLGSPANADPVPAHDVAAEELDVATGIHRIESLTSLRIRRPRHVWAGLRSFAPDDDFVIGWDTGCDGFFWLAGQGGYGIQTAAGASAAASALLLGRELPEELRAQGVDARRLSPARFAA

SEQ ID NO: 681 - DNA, 1266 bp, Unknown
  Obtained from environmental sample
atgcgtattgtcgtgattggcgcgggactgcccggagtgacgaccgcctgttttcttgcccaggccggtcatgatgtgatcgtgcttgatcgccgggaagggcctggccttgaaaccagctttgccaatggcggtatgctgacaccgagccaggccgctccctggaattctcccgggattgcgctacaggtgctcaaatggatcggtcgcgaagaatccccattcctgctcaagctgtctgaaattcccgcgttgattggttggggcagtgcgtttttgcgccattcccgggccgagcgatttctcaaaaaccagtttagcaatgcaatgctggcccgttacagtcttcagcaactgggccagctgcgtcagtcgcttggtttgcaatacgatcagtccacacgcggtacgctgaagatttaccggaccgttgcggcgcgagagcaggccgtacgtgagttgctgacggcaggcatcaaggagatacattatcaggtactcgacgcgcaaggcgtgactgcaattgaacctgcgctggagccggtcagcaagatgttggcaggcggtatttatttcccggacgatgaagcgggtgatgcccactactattgccgccaggtggccgaggctgccgcaacagcgggagcaagattcatgtatggaaccggggtgacagggctggcgcagactgcgaaccgcctgtccgcggtgaagacctctggtggggatatcgaggcagatctgtatattctcgctgccggttgttatagcccggtgctggcacggactgtaggtctgcacctgcccatttatccggtgaagggatattcgctgaccattgataccggacattgcaagggtgcattgccgctgttaccggtcattgatgagttgcgccatgttgctgtcacaccgtttgcaaaccgtttgcgtattgccggcaaggcggaacttgccggttacgataccggtatcgacgatcatcggattgcactattgctgaaattcttcagacaaatctatccacaagcaggggcgcaaatcagcgattctgaggtccggaagtgggccggtttgcgtccttacagttgtgacggcgtcccgattctcgggccatgccggctggataatctgcttctgaacaccggtcatggccatcttggctggacgctggcggctggttcggccaggttgattgcggaccatgtagccggtcatgcaacagcgctcgatttaagcccctatctgttgtcacgattcaactga

SEQ ID NO: 682 - protein, 421 aa, Unknown
  Obtained from environmental sample
  SIGNAL (1)...(22)
  DOMAIN (2)...(402): FAD dependent oxidoreductase
MRIVVIGAGLPGVTTACFLAQAGHDVIVLDRREGPGLETSFANGGMLTPSQAAPWNSPGIALQVLKWIGREESPFLLKLSEIPALIGWGSAFLRHSRAERFLKNQFSNAMLARYSLQQLGQLRQSLGLQYDQSTRGTLKIYRTVAAREQAVRELLTAGIKEIHYQVLDAQGVTAIEPALEPVSKMLAGGIYFPDDEAGDAHYYCRQVAEAAATAGARFMYGTGVTGLAQTANRLSAVKTSGGDIEADLYILAAGCYSPVLARTVGLHLPIYPVKGYSLTIDTGHCKGALPLLPVIDELRHVAVTPFANRLRIAGKAELAGYDTGIDDHRIALLLKFFRQIYPQAGAQISDSEVRKWAGLRPYSCDGVPILGPCRLDNLLLNTGHGHLGWTLAAGSARLIADHVAGHATALDLSPYLLSRFN

SEQ ID NO: 683 - DNA, 1251 bp, Unknown
  Obtained from environmental sample
atgaacgttcttgttgtaggcgctggagtggttggtaccagcacggcgctgagcctgaccgaacgcgggttccaggtcaccgtcctggaacgccatgctgaggttgccgctgaaaccagtcatgccaacggcggcggggtcaccccgggccacgccgagccctggaatgcccctggcatcatcaagcgcctgctgactcgatctggtgccggtgagccgtttcggctccatgcccatgctctgccggggctgattgaatgggggctaagctttctatggcagtcgaaggcatcacgctactacgccaatgccagaaacaacacgcggctggcggtgtattccggtgagtgcctgaagcgcctgcgccagcgccatgaactgagctatcaccagtacaccgagggttcgctggagctgtacttcagccgctcggagctggataatgcgctggatctgcgtcgcaagatcggcgatcctggcgtagagatccggatcattgatgtcaacgaagtcctggctatggagccggcgcttgagccggtggccggtcgtatggccggtgccttgctgctgccgctgcacgagtctggcgatgcctgcgctttttcagccgagatgctgcgctgcgctgaacagttgggggccaatgtccgactgggtgctgatgtcgagcgcatcgaacagcacaagggccgggtagttggcgttcgcctcaaaggcggtcagctgattgaggcggacgcggtagtcgtggccgccggctgtagctcgcctgcgctggtcaaaccgctgggcttgcgtctgccgatctatccagtcaagggctactcggcgacgctggcgctcgagcaggccgatctggcaccgaccatcccgttgctggacctggagcatcgcatcgttaccgcccgcttcggcaaccgtctgcgcatggccggcctggccgactttgatggccacaatcgcggtatacgacccgaccgactggaactgctgctggaatctgcttgtgccctgctgccgcgcctggccgacgaaatccggtccggccgcgccgaagcctggaccggcctgcgcccgatgacgcccaagggcccgcccttgatcggacccactagcattccagggttgttcctaaacaccggccacggcgccatgggctggacccaggccgctggctcggccgatctgatggccgacttgctggctgaaaaatccctcgctatcgatctcgccccttacgccccctga

SEQ ID NO: 684 - protein, 416 aa, Unknown
  Obtained from environmental sample
  DOMAIN (2)...(401): FAD dependent oxidoreductase
  SITE (107)...(110): N-glycosylation site. Prosite id = PS00001
MNVLVVGAGVVGTSTALSLTERGFQVTVLERHAEVAAETSHANGGGVTPGHAEPWNAPGIIKRLLTRSGAGEPFRLHAHALPGLIEWGLSFLWQSKASRYYANARNNTRLAVYSGECLKRLRQRHELSYHQYTEGSLELYFSRSELDNALDLRRKIGDPGVEIRIIDVNEVLAMEPALEPVAGRMAGALLLPLHESGDACAFSAEMLRCAEQLGANVRLGADVERIEQHKGRVVGVRLKGGQLIEADAVVVAAGCSSPALVKPLGLRLPIYPVKGYSATLALEQADLAPTIPLLDLEHRIVTARFGNRLRMAGLADFDGHNRGIRPDRLELLLESACALLPRLADEIRSGRAEAWTGLRPMTPKGPPLIGPTSIPGLFLNTGHGAMGWTQAAGSADLMADLLAEKSLAIDLAPYAP

SEQ ID NO: 685 - DNA, 1281 bp, Unknown
  Obtained from environmental sample
atgaataagcggacacccgaacgggttgtcgtcattggtgggggcgtggttggtgccacgaccgcgctggcgttggccgagcgcggcctgcaggtcacactggtcgagcgtaatgccgaggtggccgaggagaccagccaggcgaatgggggtggcatcaccccggcgcactccgaaccctggaacgcgcctggactgctgggcaagctggtgcgcaatctcggccgtaccgatgccccctatcggctttcaccgctggcgctgccgggaatgggtttgtggggactgcgttttctcgccaacatgcgccgtgaacggttcatcggcaatgcccgcaacaacatccgcctcggtctgtattcactcgagtgcctgcgacgctggcgcgagcgctacgacatggaatatcgacagaccctgtccgggtccatgcaggtttacttctcgcgcgaattgatggccgagtcggtgcagttccggcgcgaactgcttcaggggagtgcgccgatcgagcccatcggcgtcgacgaagtcattgccagggagccggcgctggcgccggtgcgccgcgaactggccggcgcgatcgttttcgccgagcatgagtccggcgatgcgcgccggttcagccagctcgccgccgagctggcctctgcccagggagcccaactgcagttcgacacgactgtgcagtcgattcgccttgaaagcggtcgcctacgctcggtggtgaccgatcagggtgaaatcgaggccgatgcctgcgtgatcgcggccggggcggcatccgtgcaattggcacgcccgctcggtctgcacctgccgatctacccggtgcgcggttactcggccactttcgaaatcgaacgcagcgatgcacttccgactctgcccatgctcgataccgccaaccgcttcgtcaccctcagactgggcgagcatggcctgcgaatcgccggactggcggattttgctggccatcaccgccggatcgtgccgcggcgtatcgaatgcctgctggccggcgctcgccgcctgctgccggcactggccggcgagctggttgccgagcgggccgagttgtgggccggcttgcggccggtcactccggacggtccgccactactcggccagacccgagtgccgggcgtatacgtcaatgccggccatggacccatgggctggaccatggcctgcggatcggcagaactggttgccgcgagtctatgcggcgagcacaccacgatagatgcgggagcttaccgggtcgatcgcgcctga

SEQ ID NO: 686 - protein, 426 aa, Unknown
  Obtained from environmental sample
  SIGNAL (1)...(24)
  DOMAIN (8)...(408): FAD dependent oxidoreductase
MNKRTPERVVVIGGGVVGATTALALAERGLQVTLVERNAEVAEETSQANGGGITPAHSEPWNAPGLLGKLVRNLGRTDAPYRLSPLALPGMGLWGLRFLANMRRERFIGNARNNIRLGLYSLECLRRWRERYDMEYRQTLSGSMQVYFSRELMAESVQFRRELLQGSAPIEPIGVDEVIAREPALAPVRRELAGAIVFAEHESGDARRFSQLAAELASAQGAQLQFDTTVQSIRLESGRLRSVVTDQGEIEADACVIAAGAASVQLARPLGLHLPIYPVRGYSATFEIERSDALPTLPMLDTANRFVTLRLGEHGLRIAGLADFAGHHRRIVPRRIECLLAGARRLLPALAGELVAERAELWAGLRPVTPDGPPLLGQTRVPGVYVNAGHGPMGWTMACGSAELVAASLCGEHTTIDAGAYRVDRA

SEQ ID NO: 687 - DNA, 957 bp, Unknown
  Obtained from environmental sample
gtgcggatactcgtcatcggagccggggtctccggcctgaccaccggcctcctgttgctgcgcgacgggcacgagatcaccatatgggccaaagacgtgccgccgcacaccacgtccaaccgcgcggccgccgtgtggtatccctatcgcgccgcgccaatcgaccgtgtcacacgctggggcgcggccagctaccgcacgttcgtacgcatagctgcggaagagccagaggctggcatcctcgtttccaccgtcttcgacctgcgcgcggagcgtgacgacacactgcctgaatgggcatcggaagtgggcggggtacgccatgcgactgccgaagagctgccaccaggctacgccgatgccttcgtcttcgacacgccggtgatcgacacctcgatctatatgagctacctgcgcgcagcggtcgagcaggcaggcgggcggatcgagcagcgcgccgtagactctctggacgaagcgtttgccgcgtcgagtgtagtggtgaactgcgccggcctcggctcgcgcgagctgctgggcgacacggacgtgcacgcggcacggggacaggtggtgcgcgtgcggcataacgggtatcggcgcgtgctgctggacgactttggcccgaacgcgctggcatacatcgtcccacgcctgcacgacatcatcctcggcggcacggacgaagaggatcgcgaggacaccacccctgatcccgagcagacgcgcggcatcctgcaacgctgtgccaagctggcgcccgagttcgccggcatcaccgaagaggatattctcgaagtgcgctgcgggctgcgtcccctgcgctccacggtgcggctggagctggagcgtcccgcgccggatcgtatgctggtacataactacggccatggtggcgcgggcgtcacactctcatggggctgcgccgccgaggtggtggagctgctgcattcctga

SEQ ID NO: 688 - protein, 318 aa, Unknown
  Obtained from environmental sample
  DOMAIN (2)...(315): FAD dependent oxidoreductase
  SITE (295)...(313): D-amino acid oxidases signature. Prosite id = PS00677
MRILVIGAGVSGLTTGLLLLRDGHEITIWAKDVPPHTTSNRAAAVWYPYRAAPIDRVTRWGAASYRTFVRIAAEEPEAGILVSTVFDLRAERDDTLPEWASEVGGVRHATAEELPPGYADAFVFDTPVIDTSIYMSYLRAAVEQAGGRIEQRAVDSLDEAFAASSVVVNCAGLGSRELLGDTDVHAARGQVVRVRHNGYRRVLLDDFGPNALAYIVPRLHDIILGGTDEEDREDTTPDPEQTRGILQRCAKLAPEFAGITEEDILEVRCGLRPLRSTVRLELERPAPDRMLVHNYGHGGAGVTLSWGCAAEVVELLHS

SEQ ID NO: 689 - DNA, 1248 bp, Unknown
  Obtained from environmental sample
atggctcaggacgtgatcgtgctcggcgcgggcatcgtgggagtatgcgttgcgctgcatctgcaacaacgcggatggcaggtgacgctcgtcgaccgacacgcgcccggcgaggcgacgagcttcggcaatgcgggcctgatcgaggcgtcgtcggtcgtgccctatgcgtttccgcgcgactggcgcaccgtgctgaagttcgcgatgaaccgctcgaccgcgctgcgctacgacctgcgctcgctgccggcgtatgcgccgtggctcgcgcggttctggtgggagtcggcgcccgagcgtctcgccgccgccgcgcgcgacatgctgccgctcattcgacgcagcgtcgcggagcacgaggcgctcatctcgcgggcgggtctcgacgacctcgtgcggcccacgggctggctcgaagcgtatcgctcgcgcgaacagttcgaccatgaggtgagcgccgccgaacgaatcgcgcgcgagcacgggctcggcatgaaagtgctcgatgctggagcgctgcatcggctggaggcatcgctcgacggcgcatacgcgggtgcgatccactggacggacccgcgcagcgtgatcgatccgggagcgctgacgaaaggctatgctgcgctgttcgagcgcgacggcggacgcttcctgaacggagatgccgcgacgctcgaggcgtcgcgaagcggctggcgcgtgatgaccgggagcgggccggtcgaggcgcaggcggcggtcgtagcgctcggcttatggtccggcgatctcgcgcgcaggttcggataccgcgtgccgctcatggccaagcgcggctatcacatgcattacgagagcgatggacgcggcgcgctatcgaggccggtagtcgacatcgagaacggctatgtggtggcgccgatgcggcgcggcctgcgtctgaccaccggcgtcgagctcgcctgccgtaacaggccgccgagcccggtgcaattggagcgcgcggagcggcttgcaagacccgtgttcggcctcggggcccgggtcgacgaggcgccctggcttggcctgcggccttgcacgccggacatgcggccagtcatcgggcccgcggaccgccaccctggactctggttcgccttcggacacgcgcatcacgggcttacactcggaccggtcacgggaagactgcttggggagctgatgagcggggaagcgggtttcaccgatcctgtcccttatcgaatcggaaggttctcgcaatag

SEQ ID NO: 690 - protein, 415 aa, Unknown
  Obtained from environmental sample
  DOMAIN (4)...(395): FAD dependent oxidoreductase
  SITE (72)...(75): N-glycosylation site. Prosite id = PS00001
MAQDVIVLGAGIVGVCVALHLQQRGWQVTLVDRHAPGEATSFGNAGLIEASSVVPYAFPRDWRTVLKFAMNRSTALRYDLRSLPAYAPWLARFWWESAPERLAAAARDMLPLIRRSVAEHEALISRAGLDDLVRPTGWLEAYRSREQFDHEVSAAERIAREHGLGMKVLDAGALHRLEASLDGAYAGAIHWTDPRSVIDPGALTKGYAALFERDGGRFLNGDAATLEASRSGWRVMTGSGPVEAQAAVVALGLWSGDLARRFGYRVPLMAKRGYHMHYESDGRGALSRPVVDIENGYVVAPMRRGLRLTTGVELACRNRPPSPVQLERAERLARPVFGLGARVDEAPWLGLRPCTPDMRPVIGPADRHPGLWFAFGHAHHGLTLGPVTGRLLGELMSGEAGFTDPVPYRIGRFSQ

SEQ ID NO: 691 - DNA, 1239 bp, Unknown
  Obtained from environmental sample
atgaaaacaattgctgttcttggcgcaggtgtcacgggaataaccacagcctacgcccttcagaaacgcggatttgacgtctcaattatcgatcgccagcgctatgcggcgatggaaacatcctttgccaatggcggacaactatcggcctcgaacgccgaggtttggacgcgctggtctacggtgctcaaagggctcaaatggatgacccagcgcgacgcgccacttttgatgaacccctatcccacatggcataaatactcgtggattgctgagttcatggcctcgatcccaaaatactcagccaacacaattgaaacggcacggatggcgatacaggcgcgcgagccgcttttggcttgggcgaaagaggccggcgttgagttcgatccagaaatgcgcggaatattgcacatttaccgcagcaaaaaagagtttgaccacgcaaccatggtcaatggattgctcgctaaagcaggcctcgagcgccactctgtcacgccgaaggagatgctggagattgagccaacgctcaagggtgatttctatggcggttattacactgaaagcgattttacaggcgacatccataaatatactgttgggcttgcaaaggcctttgaggccaatggcggcaagctgttacttgaacgcgagataacgtccgcatctgctatcggtgacaaaggcgtagcggtgatggtgcgcactaagtccaatgagatcgaatcgcttagctttgattcctgtgtagtttgcgcaggtattggtagccgcgacatcgcgcgccagttgggggatcgggtcaatatttatcccgtcaaaggctattcaatcacggtcaatctatctgacaaagcgagccaaaaggcagcgccaaccgtgagccttcttgacgatgagacgaaacttgtctcctcgcgcctcggcaaagatcggctgcgcgttgcaggaacggcggagttcaacggctacaaccgcgatatccgggcagaccgcatcaagccgctggtcgattgggtgaatgccatttttcctgatgtgtcgactgaaacggtggtgccatgggcaggtctgcgccctatgatgccaagcatgatgccgcgcgtcgggcgtggaaaacatcagggtgtcttctacaacaccggccatggccatctcggatggacgctatcggcatgcacggcggagatgatctcggcacttgtagaagcgaacgcccactccaacgcgccatga

SEQ ID NO: 692 - protein, 412 aa, Unknown
  Obtained from environmental sample
  SIGNAL (1)...(19)
  DOMAIN (3)...(402): FAD dependent oxidoreductase
  SITE (286)...(289): N-glycosylation site. Prosite id = PS00001
MKTIAVLGAGVTGITTAYALQKRGFDVSIIDRQRYAAMETSFANGGQLSASNAEVWTRWSTVLKGLKWMTQRDAPLLMNPYPTWHKYSWIAEFMASIPKYSANTIETARMAIQAREPLLAWAKEAGVEFDPEMRGILHIYRSKKEFDHATMVNGLLAKAGLERHSVTPKEMLEIEPTLKGDFYGGYYTESDFTGDIHKYTVGLAKAFEANGGKLLLEREITSASAIGDKGVAVMVRTKSNEIESLSFDSCVVCAGIGSRDIARQLGDRVNIYPVKGYSITVNLSDKASQKAAPTVSLLDDETKLVSSRLGKDRLRVAGTAEFNGYNRDIRADRIKPLVDWVNAIFPDVSTETVVPWAGLRPMMPSMMPRVGRGKHQGVFYNTGHGHLGWTLSACTAEMISALVEANAHSNAP

SEQ ID NO: 693 - DNA, 396 bp, Unknown
  Obtained from environmental sample
atgaagacctttcttctccgatttttcacgtggtggaatggtgcgaccctcaacacgatgttccacacctggcgtcgtggagaacgtgtgggtgaagatgagtttggcaatgtttattatcagggcgggcaagactcggaaggccggacacgccgttgggtcattttcaacggtgaatcggaagcatctgccgttccacccggctggaatggctggctccattacacggtcgatgtcgcgccgagtgaagaagattataaaccacacgattggcagaaaaaccatcaagccaaccctaccgggacggccatggcatatcgtcctaaaggctcaattgcgtcgcaggaaaagcgtcctgtggtcactggcgattacgacgcttggtctccagaataa

SEQ ID NO: 694 - protein, 131 aa, Unknown
  Obtained from environmental sample
  DOMAIN (27)...(130): NADH ubiquinone oxidoreductase subunit NDUFA12
MKTFLLRFFTWWNGATLNTMFHTWRRGERVGEDEFGNVYYQGGQDSEGRTRRWVIFNGESEASAVPPGWNGWLHYTVDVAPSEEDYKPHDWQKNHQANPTGTAMAYRPKGSIASQEKRPVVTGDYDAWSPE

SEQ ID NO: 695 - DNA, 1164 bp, Unknown
  Obtained from environmental sample
atgcttttcggaaaatggagaagcagtcgagaggacacacatatgcaaacggactatctgatcataggcgcaggtatagccggagcgtccataggctactggctcgcgccacatgcgaaagttgttttgctggaacgggaaacacaaccgggttatcacagcaccggccgctccgctgcgcttttcatggaaagctacggcccgcctcaggtgcgcgcactcacctgcgcgagtcgcgcgtttttcgagaggccgcccgccggcttcaccgaccaccccatcctttcgcctcgaggtgcaatgatggtggccggcatcggccaggaagatttgcttgaggcccagtatgcgattgtgcagtccgtctcggatgacgcaaggctgctggatgtcgcaggcgcccaccagttggtgcctgtgttgcgccccgaccgggtactcggcgcggtatacgaaccggacgccgccgacatcgatgtgcattccctgcatcacggctacctgcgtggtgtcagggccgcgggcggtacgatttcctgtggcgccgaagtgactgccatggaatatcatcgtggtgtctggcgcgtgactgcaggcgaccacatttatgaagcgcctgtcgtcgtcaacgccgccggcgcatggtgcgacgttatcggatcgcttgccggcgcagcgccaaccggattggttccgatgcgccgctccgcttttacgttcgccccgcccgacggcgtcgatagctcccgctggccgatgttcatcgctgccgacgagtccttttacgtgaagccggatgccggattgctgctcggctcgcccgccaacgccgatccggtagcgccgcacgacgtccaggcggaagagctggatattgcgctggcaatcgatcgcatagaaaacatgacgaccatgacgatccgccgcccgaagaatgtctgggcgggactgcgttcgtttgtcggagacggtagcctggtcggcggttttgacgcgaacgtgccgggttttttctgggccgccggacaaggcggttacggcattcagtcctcggcggctgcaggtgaactctatgcaacactgctgaggggcctgcctgcgccgtcgcgaatcagcgacttcggcgtgcacatagaggcgctgagtcctgcgcgtatcaggtaa

SEQ ID NO: 696 - protein, 387 aa, Unknown
  Obtained from environmental sample
  DOMAIN (18)...(361): FAD dependent oxidoreductase
  SITE (305)...(308): N-glycosylation site. Prosite id = PS00001
MLFGKWRSSREDTHMQTDYLIIGAGIAGASIGYWLAPHAKVVLLERETQPGYHSTGRSAALFMESYGPPQVRALTCASRAFFERPPAGFTDHPILSPRGAMMVAGIGQEDLLEAQYAIVQSVSDDARLLDVAGAHQLVPVLRPDRVLGAVYEPDAADIDVHSLHHGYLRGVRAAGGTISCGAEVTAMEYHRGVWRVTAGDHIYEAPVVVNAAGAWCDVIGSLAGAAPTGLVPMRRSAFTFAPPDGVDSSRWPMFIAADESFYVKPDAGLLLGSPANADPVAPHDVQAEELDIALAIDRIENMTTMTIRRPKNVWAGLRSFVGDGSLVGGFDANVPGFFWAAGQGGYGIQSSAAAGELYATLLRGLPAPSRISDFGVHIEALSPARIR

SEQ ID NO: 697 - DNA, 1257 bp, Unknown
  Obtained from environmental sample
atgaaggtcgttgtgctcggggccggcgcgatcggcgtggcgacggcctattacctgcagcgtctcggccacgacgtcacggtgatcgagcggcagagtggagccgccctcgaaaccagcttcggcaacggcgccatcatccatgcgagcgaggcggggccctggtcgcagcccggcatgccgctcaagatcctgaaatggctggggcgcgaggatgcgcccgtcctgctccgcgcggcggcattgccgcagatgtggcgctgggggcttagcttcctcgccaactgcagcagcgatcgcttccgccagaatgcgcaggccaatctccgtctggtgctctacagcctgcgctcgctgcaggagatccgcgcggaaaccggcatcgactacgatcacgccaccaacggcgtgatgaagatctatcgcgacccgcaatctttcgcggcgggtcgcgcgaaggtggcggccctcgccgcgcacgggctggtggcggacgaactctcacccgccgactgcgcgcgggtggagccggcgctggccgacaccgccagctcgctcgttggcgggctgcatttcacccgcgatgaaaccggcgactgcaatctgttcatgcaaggcctcgcgtcccacctcgcgcagcgcggcgtgactttccactacgacacgcgcatcgaccgcctggtcgcgcaatccggccgcattaccgcggtcgagacctcacgcgggcccatcgatgccgacatcgtcgtcgcggcgttgggcagcttcacgccgcatctgctgcgcccgctgggactcaagctgcccatctatccggtgaaaggcgtctccgtcaccgtgccggccgcgggatggaacgccgcgccgcgcatggcgatcatcgacgatggccgcatgttcggcctgatccgcatcggcgatcgtttgcgtgtcgccggctcggcggagatcacggactacgacacgacgcccagcccagcgcgcatcaaggccgtgatcggcaaggcgttggagacgttcccgggcttcgcccgctgctacgcgcccgagaccgccaaggtctgggcaggattgcgccccgtcacgcccagcggtgttgcctatatgggccgcacgccgatctccaacctgatcgtcaatgcgggccacggccatctcggctggacgatgtcgtgcggggcggggcgcctcgtcgccgacatcgtcagcggccgcccgcccggcatcgacatggcggggttcccgacgctgcactga

SEQ ID NO: 698 - protein, 418 aa, Unknown
  Obtained from environmental sample
  DOMAIN (2)...(401): FAD dependent oxidoreductase
  SITE (96)...(99): N-glycosylation site. Prosite id = PS00001
MKVVVLGAGAIGVATAYYLQRLGHDVTVIERQSGAALETSFGNGAIIHASEAGPWSQPGMPLKILKWLGREDAPVLLRAAALPQMWRWGLSFLANCSSDRFRQNAQANLRLVLYSLRSLQEIRAETGIDYDHATNGVMKIYRDPQSFAAGRAKVAALAAHGLVADELSPADCARVEPALADTASSLVGGLHFTRDETGDCNLFMQGLASHLAQRGVTFHYDTRIDRLVAQSGRITAVETSRGPIDADIVVAALGSFTPHLLRPLGLKLPIYPVKGVSVTVPAAGWNAAPRMAIIDDGRMFGLIRIGDRLRVAGSAEITDYDTTPSPARIKAVIGKALETFPGFARCYAPETAKVWAGLRPVTPSGVAYMGRTPISNLIVNAGHGHLGWTMSCGAGRLVADIVSGRPPGIDMAGFPTLH

SEQ ID NO: 699 - DNA, 1245 bp, Unknown
  Obtained from environmental sample
atggcgcgcaccgacgccgttgtactgggcgccggcatcgtcggcacttcgatcgcactgcacctcgccaagcgcgggctttcggtcgcgctggtcgacaaggggccgccgggcgagggcacctcctacggcaatgccggcgtgatcgaggccaacacgctgctgccgcatccgtttccgacgtcgttcggcgccatcctgaacgtcgcgctcaagcgggcgaccgaggccaattatcacctctcgttcctgccgcacatcgccccctggctgcttgaatatcgtgccaactccaccatcgagcgccgcatccgctacgccaacctgatgcggccgctgttcgcgcacgcgctgcccgagcacgaagcgctgatgctggagtcgggcgcgacgagatatcttcgcaaggaaggctggctcaaggtctatcgcaacaaggcgacgttcgatggaaccgcacgcgagcgcgcgctcgctgccgaattcggcctgccgcacgaggcgctcgaccgcgacggcgcgctggcgctcgaaccggcgctggcgccgcaattcgtcaacggcatctactggaagagctccgccagcgtgaccaatccgctggcgctgacgcgcgcctacatcgcgcgtttcaccacgctcggcggcgtggtgctgaccggcgatgcgcgcacgctgcatcgcgccaacgaccgctggcgggtcgagaccgacgaaggcccggtcgattcccgcgaggcggtggtggcgctcgggccatgggcgaccgatctcctgaagccgatggatgtcgatctcccgctcgaggtgaagcgcggctatcacctgcatttccgcccgcgcggcaatgccggcctgacgcgtccggtggtcgatgccgatgtcggctactgcgtcgcgccgatggagcaggggctgcggctcaccaccggcgccgagttcgccgaccgcgacgcgccgcccacgccggtgcagttcggccggctgttgccgcaggcgcgcgcgctgtttccgctcggcgagcaggtcgaggcgcagccgtggatgggttgccgtccgtgctttgccgattcaatgccggtgatcggccgcgcgcccggaaagaccgacctgtggcttgcttatggccacgcccattggggcctgacgctcgggccggtgaccgggcggctgctcgccgagatgatgaccggcgcgacgccgttctgcgacccgacgccctacgccgcggaacggtttcagtga

SEQ ID NO: 700 - protein, 414 aa, Unknown
  Obtained from environmental sample
  DOMAIN (5)...(395): FAD dependent oxidoreductase
  SITE (98)...(101): N-glycosylation site. Prosite id = PS00001
MARTDAVVLGAGIVGTSIALHLAKRGLSVALVDKGPPGEGTSYGNAGVIEANTLLPHPFPTSFGAILNVALKRATEANYHLSFLPHIAPWLLEYRANSTIERRIRYANLMRPLFAHALPEHEALMLESGATRYLRKEGWLKVYRNKATFDGTARERALAAEFGLPHEALDRDGALALEPALAPQFVNGIYWKSSASVTNPLALTRAYIARFTTLGGVVLTGDARTLHRANDRWRVETDEGPVDSREAVVALGPWATDLLKPMDVDLPLEVKRGYHLHFRPRGNAGLTRPVVDADVGYCVAPMEQGLRLTTGAEFADRDAPPTPVQFGRLLPQARALFPLGEQVEAQPWMGCRPCFADSMPVIGRAPGKTDLWLAYGHAHWGLTLGPVTGRLLAEMMTGATPFCDPTPYAAERFQ

SEQ ID NO: 701 - DNA, 981 bp, Unknown
  Obtained from environmental sample
atgaatcgaagtgtcgcaatcatcggtgcgggcgtttccggactgacatgcggcgtggttttcgccgaggcagggtatagcacagcgatcttcgccgaagaaatcggccgccataccacgtccggcgcggctggggcgatatggttcccgtacgatgccgaaccggctgaaaaagtgattccgtgggcgctcgaaagctacgacaggcttgtcgatctcactcgcattcctgaaagcggtgtctcgatgatcgagacacgccaattttcccggagcacggaaattcaaattccagattgggcgactccgctgggcgcacagcggctttcttccgtagcaactggcctgtttccggctcgcagtcacgcacagcgcgatggctacaatttcaagagcggtttctcgctgcgcgtccctttgacggacacaacgatttatctcgactatctcgcagcgagatttcgcgatgctggcggagacatcaacaggaaaatccagtttggaaaactcgaagaggtggatacaagattcgatctcgtacttaattgcgcaggaatcggtgcgcgcgatctcgtatcggatgccgatctcgagccgcatcgcggccaggtcgcaatcgtgccgaaaatcgaggggctttcctgcgcgattgtgtgtgatgacgcaccgctcatgtacgcaatcccgcgcagaaacgattgcctctttggcggaacaaacgatgtcagagacgatctcgcgcctgatcccggaaccacaggacgaatcattggcgaatgcagccgtgtgttgaacatcgaaacaccgccggtaatcgccgagcgcgtcggtctgcgcccgtttagaagatcaggcgtgcgcgtggaactcgatcagttgcgcgacggtcgcactgtcattcacaactacggccacggcggctccgggttcacgctctcctggggttgcgcccgtgaagcccttgatttggctaaatcataa

SEQ ID NO: 702 - protein, 326 aa, Unknown
  Obtained from environmental sample
  SIGNAL (1)...(22)
  DOMAIN (4)...(323): FAD dependent oxidoreductase
  SITE (2)...(5): N-glycosylation site. Prosite id = PS00001
  SITE (303)...(321): D-amino acid oxidases signature. Prosite id = PS00677
MNRSVAIIGAGVSGLTCGVVFAEAGYSTAIFAEEIGRHTTSGAAGAIWFPYDAEPAEKVIPWALESYDRLVDLTRIPESGVSMIETRQFSRSTEIQIPDWATPLGAQRLSSVATGLFPARSHAQRDGYNFKSGFSLRVPLTDTTIYLDYLAARFRDAGGDINRKIQFGKLEEVDTRFDLVLNCAGIGARDLVSDADLEPHRGQVAIVPKIEGLSCAIVCDDAPLMYAIPRRNDCLFGGTNDVRDDLAPDPGTTGRIIGECSRVLNIETPPVIAERVGLRPFRRSGVRVELDQLRDGRTVIHNYGHGGSGFTLSWGCAREALDLAKS

SEQ ID NO: 703 - DNA, 1248 bp, Unknown
  Obtained from environmental sample
atggcccggaccgatgcgatcgtgctgggggccggcatcgtcggcatctcggcagcgctgcatctcgccaagcgcgggctcgcggtggcgctggtcgaccggcgcggaccggccgaggaaacgtcgtacggaaatgccggcgtgctggaaggcaatacgctgttcgcgcatgccttcccgaaaggcttcggtgcgctgcttcgtatcgcgctgaagcaggcgcccgaggcgaattatcatctctcggcgctagccggcctcgcgccgtggctgcttgcctatcgcgccaatacgcgcggccaacgcgcgctggagtttgccaaagcgatgcggccgctctttgctcgcgcggtcgctgagcacgagacgctgatgggcgaggcgaatgcgtctcgctatctgcgcaaggacggttggatcaaagtctatcgcagcggcgaatcctttcaggatacggagcgcgagcgcacttatgcgcgcgagcttggtctcgatcaccgcgtgatgacgccggaagaggtgcgaacgctggagccatcgctcgcgccggtgttccagcatgcggtgcattggccgagcgctgcgagcgtgtccaacccggccgcagtggcgcgcgcctatgccgaacgcttcaccaagcttggcgggatcatcctcaagggcgacgccaagacgctgcaccggtccggccagagctggcgagtcgacaccgaggaggggccgatcgacgccaaggatgccgtcgtggcgctcggcccgtgggcgcccgacctgcttgggccgctcggcatccgcctgccgctcgcgttcaagcggggctatcaccggcactaccggtccaatggcaatgccgggctgacgcggccgatcgtcgacgccgataacggctactgtctcgcgccgatggagcagggcatccggctcaccaccggcgcggagttcgcccatcgcgacgacccgccgacccccgttcagttcgaccggctgctgcctgcggcgcgggagctttacccgctgggcgagggcatcgaggcgcagccctggttgggctcgcggccgtgctttgccgactcgcgcccggtgatcgggcgcgctccgggccagccggggctctggctcgactacggccacgcgcattggggactgacgcttgggccagtgtcgggccatctcttggccgacatgatcacaggcgccacgccgttctgcaatccggcgccgttttccgccgagcggtttcaatcctga

SEQ ID NO: 704 - protein, 415 aa, Unknown
  Obtained from environmental sample
  DOMAIN (5)...(395): FAD dependent oxidoreductase
MARTDAIVLGAGIVGISAALHLAKRGLAVALVDRRGPAEETSYGNAGVLEGNTLFAHAFPKGFGALLRIALKQAPEANYHLSALAGLAPWLLAYRANTRGQRALEFAKAMRPLFARAVAEHETLMGEANASRYLRKDGWIKVYRSGESFQDTERERTYARELGLDHRVMTPEEVRTLEPSLAPVFQHAVHWPSAASVSNPAAVARAYAERFTKLGGIILKGDAKTLHRSGQSWRVDTEEGPIDAKDAVVALGPWAPDLLGPLGIRLPLAFKRGYHRHYRSNGNAGLTRPIVDADNGYCLAPMEQGIRLTTGAEFAHRDDPPTPVQFDRLLPAARELYPLGEGIEAQPWLGSRPCFADSRPVIGRAPGQPGLWLDYGHAHWGLTLGPVSGHLLADMITGATPFCNPAPFSAERFQS

SEQ ID NO: 705 - DNA, 1233 bp, Unknown
  Obtained from environmental sample
atgaagagcgcaatcgtcctcggagccggcatggtcggtgtgtccacggcgcttgcgctccgcgaccgcggctgggacatgacgctggtcgaccgcaaggcgccagggcaggagaccagcttcggcaatgccggcatcatccagggcgaggccgtcgagccctatgccatgccgcgttcgatcggcgatctcttcagcatcgcgctcggccgcagcaatgacgtgctctattccttccgcgagctgcccttccatgtctcatcgctgctgcgctactggtggcattcggcgccggtccggcatcgtaccgcgggtgctgcctgggcgtcgctcatcgttcgcgccaccggcacgcatgagccgctgatcgaacgcgccggcgccggcaacctcgtccggcgcggcgggtttcatctgatgtttcgtgggcacgacgccctggccgaggaggtcgccgacgccgaacgtaaggcggccgtctacggcacgaaattccgcacggtgacccctgccgagatgcggcaggccgagcctgctctgaagcagggtggagcaggcggtatccagtggctcgattcctggaccgtgagcgatcccggcggcctggtctgcgcctacgcggcgctgttcgagcgcagcggcggacgcttcgttcatggcgatgcgtcgaccctgcgccggtcgggttccggctgggcggtggacacggattccggcaccgtcgaggcggagacggcggtcgtcacgctcggcccgtggtcgacgaccatgctccggcgcttcggccaccgttttccgatggtccacaagcgcggctatcacgcccattaccgggcgccgcaatcgctcaatgcgccggtcatggacggcgacaacggctatctgctgctgccgatgctggccggtacgcgcatcacgacgggagcgcatatcgcgcggatcggcgtgccgccggcctatctccagctctcccgcgccgaggctgcggctgtcgatctcttcgaactcgggccgcggatcgaggacacgccctggcagggcacgcggccctgcatgccggatatgttgccggtcattggcccgtcacagcacgagaagggtctctggctgagtttcggtcacggtcatcagggatttacgctcgggccggcgagcgccgaggcgttggctgcgatgatgagcggcgagacgccgccggtcgacatggtgccgttccggccggatcggtactaa

SEQ ID NO: 706 - protein, 410 aa, Unknown
  Obtained from environmental sample
  SIGNAL (1)...(19)
  DOMAIN (3)...(392): FAD dependent oxidoreductase
MKSAIVLGAGMVGVSTALALRDRGWDMTLVDRKAPGQETSFGNAGIIQGEAVEPYAMPRSIGDLFSIALGRSNDVLYSFRELPFHVSSLLRYWWHSAPVRHRTAGAAWASLIVRATGTHEPLIERAGAGNLVRRGGFHLMFRGHDALAEEVADAERKAAVYGTKFRTVTPAEMRQAEPALKQGGAGGIQWLDSWTVSDPGGLVCAYAALFERSGGRFVHGDASTLRRSGSGWAVDTDSGTVEAETAVVTLGPWSTTMLRRFGHRFPMVHKRGYHAHYRAPQSLNAPVMDGDNGYLLLPMLAGTRITTGAHIARIGVPPAYLQLSRAEAAAVDLFELGPRIEDTPWQGTRPCMPDMLPVIGPSQHEKGLWLSFGHGHQGFTLGPASAEALAAMMSGETPPVDMVPFRPDRY

SEQ ID NO: 707 - DNA, 1275 bp, Unknown
  Obtained from environmental sample
atgagccagattttgcttttggggagcagcatggcacgtaccgatgcaatcgttctgggcgccggcattgtcggcacatcggtcgcgctgcaccttgccaaacgtggcctgtcggtcgcgctggtcgaccggcgtggtcccggcgaggagacgagctacggcaacaccggcgttattgtcggcgccagcgtgtttccgaccgcgtttccgcgcagcctgaagaagctcattcaggtcgcgctcaagcgcgcgcccgaggcgaactatcattggggcgacctgctcaagatcgcgccctggctgatttcctatttcaatttctcgacgccggagaagctgaaggacagtgccgtcaagctgcgcccgctgatgagccactcggtcgccgagcacaagctgctgctcgaagaggccggcgcgatgaaatatttgcgcgagaacggctggatgacgatttatcgcagcgatgcggccttcgaggggatgaagccgcagcttgaattcggcgcgcagatcggcgtcgcggcgcagccgctcgacatgaacgccgcgctcacgctcgagccgagcctcaatccggtgttccgccatgcgctgatgtggccggacgttgcgtcgctctccaacccgctgaaggtgacgcgcgcctacgcggcgcgcttccaggcgctcggcggcgtgctgctcaagggtgacgcgcgcaagctgcgccgcgccgacggacgctggcgcgtcgagaccgaggaggggccggtcgactcggcgaacgccgtcgtgacgctcgggccctggtcgccggacgtgctcagccccctcggcatcaaggtcccgctcggcatcaagcgcggctatcaccgccactttgagccgaagggaaatgcgtcgctcgcgcgcccggtgatcgacaccgaaatcggctatgcgatcaccccgatggagcagggcatccgcctgacgaccggcgccgaattcgccgatcgtgatgcaccgcccacgccggtgcaattcgaccgtctgctgccctacgccagagagctgtttccgctcggcgagccgaatgagccggagccgtggctcggccgtcgcccgaacatgccggactcgctgccggtattgggccgcgcgcccgggcaggatgggctctggctcgccttcggccacgggcattgggggctgaccatggcggccgtgaccgggcggctgatcgccgagctgatgaccggcgcgacgccgtttgtcgatccggtgccttaccgcgcggatcggttcaggtag

SEQ ID NO: 708 - protein, 424 aa, Unknown
  Obtained from environmental sample
  DOMAIN (15)...(405): FAD dependent oxidoreductase
  SITE (107)...(110): N-glycosylation site. Prosite id = PS00001
  SITE (297)...(300): N-glycosylation site. Prosite id = PS00001
MSQILLLGSSMARTDAIVLGAGIVGTSVALHLAKRGLSVALVDRRGPGEETSYGNTGVIVGASVFPTAFPRSLKKLIQVALKRAPEANYHWGDLLKIAPWLISYFNFSTPEKLKDSAVKLRPLMSHSVAEHKLLLEEAGAMKYLRENGWMTIYRSDAAFEGMKPQLEFGAQIGVAAQPLDMNAALTLEPSLNPVFRHALMWPDVASLSNPLKVTRAYAARFQALGGVLLKGDARKLRRADGRWRVETEEGPVDSANAVVTLGPWSPDVLSPLGIKVPLGIKRGYHRHFEPKGNASLARPVIDTEIGYAITPMEQGIRLTTGAEFADRDAPPTPVQFDRLLPYARELFPLGEPNEPEPWLGRRPNMPDSLPVLGRAPGQDGLWLAFGHGHWGLTMAAVTGRLIAELMTGATPFVDPVPYRADRFR

SEQ ID NO: 709 - DNA, 1233 bp, Unknown
  Obtained from environmental sample
atgaaattcgattcggtcgtgcttggcggcggcatcgtcggcgtttccgtggctttgcagttgcagcggcgcggcctttcggtcgcgctcgtggaccgcagggcgccgggcaatgaaacatcgcacggcaacgggggattgatccagcgcgagggcgtctacccctacgcgtttccgcgcgagctttccacgctgttgcgctacgcgcgcaaccgctcgacagacgtgcgctatcacccgggcgcgatgcccaagctgctgccttttctctatcgctattggcaccattcgcgcgccgaccggcacgcgctgatagcgcgcgcgtattccacgctcatcgagcactgcgtgagcgagcatcgcgcgctgatcgaggcggcgggcgcccaggcgctgttgcgcaccaacggctggatgaaggtgtttcgcagcgcggtcgccatggacgctacgctcgccgaggcgcagcgctggcagcgcgagtacggtgtaggccacgaagcgctggacgccgcggcgttgcgcgccgccgagcccgcgttgagccacacgctggtgggcggcgtgcgctacaccgattccgattcggttagcgatccgaagggattggtcacggcgtactcgaagctcttcgagcagctaggcggccgtgtgctgattggcgacgccgcgacgctcgaaccgtcgtggcgcgtcatgacgcaggatggtcccgtgctggcgaagtctgcggtcatcgccatggggccgtggtcgggcgatctcacggcgcggctgggctacgagttgccgctcgccgtgaagcgcggctatcacatgcactacgcggtcacgaatggcgcgaagctgaatcagccggtgctcgacgccgaagcgggcttcctgattacgccgatgctgcgcggcacgcgcctcacgacgggcgtcgaactcggctttcgcgattcgcccaagacgcccgttcagctcgaagcggtcgagccgctcgcgcgcgatattttccctctgggcgcacggctcgacgccgaaccgtggctgggccgccgtccctgcacacccgacatgatgccgatcatcggccccgcgcccaagcacgacgacctctggttcgcgttcggccacgcgcatcacggtcttacgcttggcccggtcacgggccgcctgatcgcggagatgatgacgggcgcgccgaccgtggtggacccgcggccattccgtgtcgatcggttttaa

SEQ ID NO: 710 - protein, 410 aa, Unknown
  Obtained from environmental sample
  DOMAIN (4)...(392): FAD dependent oxidoreductase
  SITE (38)...(41): N-glycosylation site. Prosite id = PS00001
  SITE (72)...(75): N-glycosylation site. Prosite id = PS00001
MKFDSVVLGGGIVGVSVALQLQRRGLSVALVDRRAPGNETSHGNGGLIQREGVYPYAFPRELSTLLRYARNRSTDVRYHPGAMPKLLPFLYRYWHHSRADRHALIARAYSTLIEHCVSEHRALIEAAGAQALLRTNGWMKVFRSAVAMDATLAEAQRWQREYGVGHEALDAAALRAAEPALSHTLVGGVRYTDSDSVSDPKGLVTAYSKLFEQLGGRVLIGDAATLEPSWRVMTQDGPVLAKSAVIAMGPWSGDLTARLGYELPLAVKRGYHMHYAVTNGAKLNQPVLDAEAGFLITPMLRGTRLTTGVELGFRDSPKTPVQLEAVEPLARDIFPLGARLDAEPWLGRRPCTPDMMPIIGPAPKHDDLWFAFGHAHHGLTLGPVTGRLIAEMMTGAPTVVDPRPFRVDRF

SEQ ID NO: 711 - DNA, 1266 bp, Unknown
  Obtained from environmental sample
atgaaggcagtcatcatcggcagcggcctgatcggcaccacatcggcctacttcctcgcgcgccgcggctgggaggtcaccgtcctcgatcgtcaggacggccccgggcaggagacgagcttcgccaacggctcgctcctgacgcccagcatgccggagccgtggaacgcgcccgggagctggcgggtgctgctcaagtccctcggccgctccgactcgccgctgcagctgcgcctcaaggcgctgccgcacctcgcgggctggggcaccgggtttctgcgcaactcgagcccggcgcgctacgcgcgcaacacggtgagaaatctgaagctcgcgctgcattccatcgaggtgatgggccgcctgcgccaggagatcgggatcgagtatggaggcgccgcgccagggacattacgagtcattcgcgatccggcggcgttcgagcgagcgcttgcgtgggcggagcagctccgggcggacggactcacataccggcgcctgagcaccgatgagatcgtggcgctggagccggcgctcgctcccgttgccgggcggctggccggcggcattcattacccggtcgatgagatcggcaacgcctacaagttttgcgtcggtctcgcggatcacgcccgccgcgccggcgtggatttccgctttcaaacgcccgtgactcgaatcgaggtccgtcaggggaaggtggcggcggtgctgagcggcgacaagcgcttcagcgccgaccgttatgtcgtggcggccggcagctacagtccgcttctcttcaaggcgctggggctccgggtgcccgtgcggccggccaaaggctactcgctgactttcgagcgtcctgccctcgacccgccgtttcgtatgcctgtggccgacgatgacttccatgccgtggtggtgccgctcgagaatgtcatccgcgtggcgggaaccgcggagttcaccgggtatgacctgtcattgccggacgcacgtattcagaatatcctgactctcgtcagggaggtgctgcccaagggcggattcgagcgcgcgggggcgaaggcgtggtgcggccttcgcccgatgtcggtcgacggcgtgccgatcatcggtccgacgccgatcgccaatctctggaccaacacgggacacggacatctcgggtggaccatggccgctgcttccggccaactcctgtcggatctcctgacgggggcatcgccggccgtcaaccccgacgcctacgctctcgcccggttcgccacagggggatag

SEQ ID NO: 712 - protein, 421 aa, Unknown
  Obtained from environmental sample
  DOMAIN (2)...(399): FAD dependent oxidoreductase
  SITE (43)...(46): N-glycosylation site. Prosite id = PS00001
MKAVIIGSGLIGTTSAYFLARRGWEVTVLDRQDGPGQETSFANGSLLTPSMPEPWNAPGSWRVLLKSLGRSDSPLQLRLKALPHLAGWGTGFLRNSSPARYARNTVRNLKLALHSIEVMGRLRQEIGIEYGGAAPGTLRVIRDPAAFERALAWAEQLRADGLTYRRLSTDEIVALEPALAPVAGRLAGGIHYPVDEIGNAYKFCVGLADHARRAGVDFRFQTPVTRIEVRQGKVAAVLSGDKRFSADRYVVAAGSYSPLLFKALGLRVPVRPAKGYSLTFERPALDPPFRMPVADDDFHAVVVPLENVIRVAGTAEFTGYDLSLPDARIQNILTLVREVLPKGGFERAGAKAWCGLRPMSVDGVPIIGPTPIANLWTNTGHGHLGWTMAAASGQLLSDLLTGASPAVNPDAYALARFATGG

SEQ ID NO: 713 - DNA, 1233 bp, Unknown; identical to SEQ ID NO: 709
  Obtained from environmental sample

SEQ ID NO: 714 - protein, 410 aa, Unknown; identical to SEQ ID NO: 710
  Obtained from environmental sample
  DOMAIN (4)...(392): FAD dependent oxidoreductase
  SITE (38)...(41): N-glycosylation site. Prosite id = PS00001
  SITE (72)...(75): N-glycosylation site. Prosite id = PS00001

SEQ ID NO: 715 - DNA, 1251 bp, Unknown
  Obtained from environmental sample
atgaaagtcattgtcatcggcgccggcgtcgtcggtgccaccacggcactgagcctggtcgagcgtggtctcgaggtcacgctgcttgatcggcatccggttccggcggccgagaccagtcacgccaacggaggcggagtcacaccggggcacgccgaaccgtggaattctcccggcatcctgggacgcctgctcaggggctccggcgaccgggcgccctaccggattcacgcccgcgccctgcccggaatgatgggctggggctcgagctttctgtggcagtcgaggtcctcgcgctacttcgtcaacgcgcgcaataacacgcgcctggcggtctactccgggcagtgcctgaagcgtctgcgcgagcgccacgcgatcagctaccaccagtacaccgatggctcgctggagctgtacttcaaccgcgctgaactggaccatgcggtcaaacttcgtcgcggcatcggcgatcctggcgttgaactcagggagatctcgcccgaccaggtagtggctatggagccggcactggctccggtggcccggcgcatggtcggtgccctgtttctgccgctgcatgaatccggcgatgcctgtgaatttgccgccgaagtggctcgttgcgcgcagggactgggggcgagtatcaggctgggccagaccgtcgaagcccttgtccaccgtagcgggagaattaccggggttcagctggtctcggggttcctggccgcggatgcagtggtgctcgcggccggcgtgtccagtcgggcactggcctggcccttgggtctgaaactgccgatcctgccagtcaagggctactcggccaccctggttctggaccagcctgagttggccccagccattccattgctggatctcgaacaccgcatcgtcaccgcccgctacggtcagcgcctgcgcatcgccggcctggcggatttcgaaggctatgattccaatatcaggcccgggcgggtccagatgctgctggattcagccactgtgctgctgccgcgcctggccgatgagttacacgctggcaaggcccagacctggtgtggtttcagaccaatgacacccaagggcccgccgctgctgggcccgacccgggttccggggttgtttctgaacactggccacggctcgatgggctggactcaggccgccggttcagccgagatcctggctgatcttgtcaccgggcgcgaagcggcgatcgatctgagcggcttgacgctcgggtga

SEQ ID NO: 716 - protein, 416 aa, Unknown
  Obtained from environmental sample
  DOMAIN (2)...(400): FAD dependent oxidoreductase
  SITE (107)...(110): N-glycosylation site. Prosite id = PS00001
MKVIVIGAGVVGATTALSLVERGLEVTLLDRHPVPAAETSHANGGGVTPGHAEPWNSPGILGRLLRGSGDRAPYRIHARALPGMMGWGSSFLWQSRSSRYFVNARNNTRLAVYSGQCLKRLRERHAISYHQYTDGSLELYFNRAELDHAVKLRRGIGDPGVELREISPDQVVAMEPALAPVARRMVGALFLPLHESGDACEFAAEVARCAQGLGASIRLGQTVEALVHRSGRITGVQLVSGFLAADAVVLAAGVSSRALAWPLGLKLPILPVKGYSATLVLDQPELAPAIPLLDLEHRIVTARYGQRLRIAGLADFEGYDSNIRPGRVQMLLDSATVLLPRLADELHAGKAQTWCGFRPMTPKGPPLLGPTRVPGLFLNTGHGSMGWTQAAGSAEILADLVTGREAAIDLSGLTLG

SEQ ID NO: 717 - DNA, 912 bp, Unknown
  Obtained from environmental sample
aaagaattggccaccacctggttggcagacgagttgttgccttttgcttatgaggcttataccgctatgggcgaactgatagggcagccagtaatatcggaaacccccattttggcatttccagccaatgcggaaatgctgcaggtatataacaaaaggataaaggagggttcgccctggatacatgcagtggagtcgccacaggcctgggaaggtattttcaactttttgcatcaggtggtatgcttgcgccccgtttacagggttcaaataggtgccatgctacaaggctgggccagcctgctggaaaagtcggatgatatttggctgcatcattttgacgatcaactacttacagtacatgacgacgggattacttatcagggcgttcatgcgaaagccttgttgttttgcgacgggtatcatgcggagaaaagcagattctggcaggggttgccttttagtgtaaataagggcgaagcattgatcgttgatattcccgcactacccggggagtatatctacaagtttgggataaccacattggcgccatggagcgatggcctgtggtgggttggtagcagttacgacaaccggtttacccatccacatcccacagaggcatttcgcaggcaaatggaattttttctggcccaaaccctgcgtgtaccttttcgtatcacagggcatatttgtggtttgcgaccggctaccatcgaaagaaggccatttgcaggcctgcatgcccggtataagcagataggtattctgaatggcctgggtaccaagggagtttcactggcgccctggtttgcccggcaactcgctctgcatttgatacaaggtgagcctatagaccccgccgccaatgtgcagcgtttcaaaagagcattcgaaaaatcaatgaattaa

SEQ ID NO: 718 - protein, 303 aa, Unknown
  Obtained from environmental sample
KELATTWLADELLPFAYEAYTAMGELIGQPVISETPILAFPANAEMLQVYNKRIKEGSPWIHAVESPQAWEGIFNFLHQVVCLRPVYRVQIGAMLQGWASLLEKSDDIWLHHFDDQLLTVHDDGITYQGVHAKALLFCDGYHAEKSRFWQGLPFSVNKGEALIVDIPALPGEYIYKFGITTLAPWSDGLWWVGSSYDNRFTHPHPTEAFRRQMEFFLAQTLRVPFRITGHICGLRPATIERRPFAGLHARYKQIGILNGLGTKGVSLAPWFARQLALHLIQGEPIDPAANVQRFKRAFEKSMN

SEQ ID NO: 719 - DNA, 1251 bp, Unknown
  Obtained from environmental sample
atggctgggaccgatgtgatcgtgctgggcgccggcatggtcggcgtatcgacggcgctgcatctgcaaaagcgcggccagagcgtggtgctggtcgaccgccgcggcgccggcgaggagacgagctacggcaataccggcatcatccaacgcgagggcgtcgtgccctacccgtttccgcgcgacgtttccctgctgctgcgctacgccctcaatcgcctgcccgagtcgcacctcgattggcgggcgctgcccgccatcgcgccttggctctttcgctactggcgggcctccacgcccgcagccatcgcctcgacctcgcgcggggcacggccgctgatcgaacgttgcgtgatcgaacacgaggctttgatgggcgaagccggcgcgctcggtctcatgcgccgcaccggctatctgcgcctctatcgctcgctgtcggcgctagacagcgccatggcgaaggacaaggccgccagcgaaacctatggcgtcaatttcgagatgctgggggccggcgcgctctcctcgctggagccgcacctgaaggccacgctggcgggcgccatgttcatgcccgatccggtcagcgtctcggaccccgaggccgtcaccaaggcttacgcccgcctgtttcaggagcgcggtggccgctttgcccgcggcgaggccggcactctcaaagccgcgtccgggggatgggaggtgcagacggccggcggcagcatcagcgctcccgccgtggtgatcgcgctcgggccctggtccaacaccttgttccgccggctcggctaccgcatcccgtttggcgtcaagcgcggctatcacatgcattaccgtgccgaaggcaatgccaccctcaaccggccggtgatcgatgccgagtacggctatgccttaacgccgatggcgcgcggcatccggcttaccacgggtgccgagtttgccttgcgcgatgcgccgccgacgcccgtgcagctcgcccgcgtcgagcccttggcgcgccagattttcccgctcggcgagcggctcgacgccgagccatggctcggccggcgtccgtgtctgcccgacatgctgccggcggtgggccgcggcgcacatcacagcggactgtggttcaatttcggccatcatcacttgggctttaccctggggccggtgaccgggcgtctgctggcggagatgatgaccggcgagacgccgttcaccgatccgacgccctacggccccgagcgcttcggctcatga

SEQ ID NO: 720 - protein, 416 aa, Unknown
  Obtained from environmental sample
  DOMAIN (5)...(396): FAD dependent oxidoreductase
  SITE (288)...(291): N-glycosylation site. Prosite id = PS00001
MAGTDVIVLGAGMVGVSTALHLQKRGQSVVLVDRRGAGEETSYGNTGIIQREGVVPYPFPRDVSLLLRYALNRLPESHLDWRALPAIAPWLFRYWRASTPAAIASTSRGARPLIERCVIEHEALMGEAGALGLMRRTGYLRLYRSLSALDSAMAKDKAASETYGVNFEMLGAGALSSLEPHLKATLAGAMFMPDPVSVSDPEAVTKAYARLFQERGGRFARGEAGTLKAASGGWEVQTAGGSISAPAVVIALGPWSNTLFRRLGYRIPFGVKRGYHMHYRAEGNATLNRPVIDAEYGYALTPMARGIRLTTGAEFALRDAPPTPVQLARVEPLARQIFPLGERLDAEPWLGRRPCLPDMLPAVGRGAHHSGLWFNFGHHHLGFTLGPVTGRLLAEMMTGETPFTDPTPYGPERFGS

SEQ ID NO: 721 - DNA, 918 bp, Unknown
  Obtained from environmental sample
atgcacgaggtgacggtggtcggcgcgggcgtggtagggctgaccaccgcggtccgtctccaggaagcgggacaccgggtccgtgtcgtctcggccgagcgccccgagcgaaccacgtccgccgccgccggcgccgtctggtaccccttctcggtcggccccccggaggcggtgagtcgctgggcccgggcgacgcgggcctggctgctcgagctgtcccgcaccgtgccccaggccggcgtggacatgctcaccgtccgcgagtgcgctgccgacgagcagcgcccctggtgggcagacgcggtcgagccggtccggctggtccacggcgcacagccgagcggggcgcacctcgcctgggagttcgaggcgccgcgggtcgagcccgcgctccatcttcgctggctggagtcgcggctcgaccggccgatcgagatcgcccccgtcgatcggctggacgacgtccccggtgacacggtggtgaactgcacggggatcggggcccggcggctcaccggcgaccagacgctgcaggcgctgctcgggcagacggcgatcgtcgagccgggtgaggtcgacccccggaagatgtacggcgacgagcgcgacctctcgaggatgctctacgtcatcccgcggcgaggcgaggtggtcgtcggcggatgcgcccttcccttcgacggcgacgtgccgcctccgcccgatgctgcgctccggactgcaatcctggagcgggcgcgcgcggcgggattccgccacggtccggtgctccgggacgcggtggggctgcgtccggtccgtcccgaggtgcgggtcgagcgcgtgggacgcatcgtccatcactacggtcacggcggcgccgggtacacgctcgccaggggctcgtccggagacgtcgcgtcgctcgtcgcacggtga

SEQ ID NO: 722 - protein, 305 aa, Unknown
  Obtained from environmental sample
  DOMAIN (3)...(302): FAD dependent oxidoreductase
  SITE (164)...(167): N-glycosylation site. Prosite id = PS00001
MHEVTVVGAGVVGLTTAVRLQEAGHRVRVVSAERPERTTSAAAGAVWYPFSVGPPEAVSRWARATRAWLLELSRTVPQAGVDMLTVRECAADEQRPWWADAVEPVRLVHGAQPSGAHLAWEFEAPRVEPALHLRWLESRLDRPIEIAPVDRLDDVPGDTVVNCTGIGARRLTGDQTLQALLGQTAIVEPGEVDPRKMYGDERDLSRMLYVIPRRGEVVVGGCALPFDGDVPPPPDAALRTAILERARAAGFRHGPVLRDAVGLRPVRPEVRVERVGRIVHHYGHGGAGYTLARGSSGDVASLVAR

SEQ ID NO: 723 - DNA, 1251 bp, Unknown
  Obtained from environmental sample
atgcacaccattgtcatcggcgccggcgtcgtcggcgccagcacggcgctgagcctggccgaacgcggcattcaggtcaccgtcctggatcgtcacgccgaggctgccgctgaaaccagccatgccaacggtggcggtatcactccgggccatgccgagccctggaacgccccaggcatcgtcaaacgtttgctgacccgttctggtgccggcgagccgtttcgtatccatgcccatgccctgccagggctgatcggatggggactcagctttctgtggcagtcaaaggcatcgcgctactacctcaatgccaggaacaacacgcggctggcggtgtattccggccaatgcctgaagcgcctgcgcgagcgccatgcgctcagctatcaccagtacaccgacggctctctggagctctacttcagccaatccgaactggaccatgcgctcgacctgcgccgcaagatcggcgatcctggcgtcgagatccgggttatcagcgtcgacgaagtgcttgccatggagccggcgctcgaaccggttgccgggcggatggtcggtgccatgctgctgccgctgcacgaatccggcgatgcctgcgttttttcagccgagatgctgcgctgtgccaagcagctgggggccaaaatccggctgggtaccaatgtcgatcgcatcgaacagcgccagggccgggtggtcggtgttcgccttcatgaccagcaattgctggaagccgatgcggtcgtcgttgccgccggctgcagctcgcctgcgctggtcaaaccgctgggcttgcgtctgccgatctatccggtcaagggctattcggccacgctggcgctcgaacagaccgatctggcaccgaccgttccgctactggacctggaacatcgcatcgttaccgcccgcttcggcaagcgtctgcgcatggccggcctggccgactttgacggccacaatcgcgatatccgatccgaccggcttaacctgctgctggaatctgcctgtgccctgctgccgcgcctggccgacgaaatccggtccggccgcgccgaagcctggaccggcctgcgcccgatgacgcccaagggtccgcccttgatcggccctacacgcattcccggtttgttcctgaacaccggccacggcgccatgggctggacccaggccgccggctcggccgaggtgctggccgatctgctgatcggacggaccccaggggtcgagcttgccccttatatcccctga

SEQ ID NO: 724 - protein, 416 aa, Unknown
  Obtained from environmental sample
  SIGNAL (1)...(20)
  DOMAIN (2)...(401): FAD dependent oxidoreductase
  SITE (107)...(110): N-glycosylation site. Prosite id = PS00001
MHTIVIGAGVVGASTALSLAERGIQVTVLDRHAEAAAETSHANGGGITPGHAEPWNAPGIVKRLLTRSGAGEPFRIHAHALPGLIGWGLSFLWQSKASRYYLNARNNTRLAVYSGQCLKRLRERHALSYHQYTDGSLELYFSQSELDHALDLRRKIGDPGVEIRVISVDEVLAMEPALEPVAGRMVGAMLLPLHESGDACVFSAEMLRCAKQLGAKIRLGTNVDRIEQRQGRVVGVRLHDQQLLEADAVVVAAGCSSPALVKPLGLRLPIYPVKGYSATLALEQTDLAPTVPLLDLEHRIVTARFGKRLRMAGLADFDGHNRDIRSDRLNLLLESACALLPRLADEIRSGRAEAWTGLRPMTPKGPPLIGPTRIPGLFLNTGHGAMGWTQAAGSAEVLADLLIGRTPGVELAPYIP

SEQ ID NO: 725 - DNA, 1260 bp, Unknown
  Obtained from environmental sample
gtgaaggtcgtggtgctcggagcgggcgtgatcggcgtgaccagcgcctggtacctgtcggaggcaggacatgaggtgacggtcgtcgatcggcagccgttcgccggcctcgaaaccagcttcgcgaacggcggccagatctcggtcagccacgccgaaccctgggccaacccgggcgcgccgctcaacatcctgcgctggctcggccgggaagatgccccgctgctgttccgcccgcgcgtgagcccgcgccaatggagctgggggctgcgcttcctgtacgaatgcctgccgggacgcacacgccgcaacacgctcgagatcctcaagctcgcgctgtacagccatcgggagctgaaggcgctgcgcgcgaagaccggcattcgctacgatcattccgagcgcggcatcctgcatctgcactcggacccgcgggcgctcgacgcagcgcgccaccgcgtcgagctgatgcgcgatcacggcttcgacatgcagctcaagaccgcgcagcagtgtctcgagatcgagcccgcgttgaaatacacgctcgcgagcctcgccggcggcacctacgcgccgagcgacgagtccggcgatgcacatcagttctcgcgtcaggtcgaagagctgtgccggcgggccggcgtcgcgttcgcattccagtcgaccgcgcagcgcctgctgctcgaaggcgggcgcatcaccggcatacgcatacggcatgtcgagggccccgagcagaccctgcgcgcggacgcgtacctgatgtgcatgggcagcttcacgccgttcctggtcgagcccgcgggcgtccggctgccggtctatccggtcaagggttactcggtgacgataccggtgccgcccgaagcggacggtgcgccgctcgtctgcctctccgacgaagccggtaagctcgcgatatcgcgtctcggcaatcggctgcgcgtcgccggaaccgccgagctcaacgactacgacagctcgatcaatccgtaccgctgcgcggcgatcctggcacgcgccgaagagctgtttcctcgcggcggcgccttcgatcgtgcgcagccgtgggccggcctgcgtccggccacgccgagcaacgtccccgtgatcgggcgcacgcgactctccaacctgtacctgaacaccggccacggcacgctcggctggacgctagcgtgcggctcgggccgcgcgatcgccgacatcatcagcggccgcaggcccgacgtcgattttgccttccgcggcggctga

SEQ ID NO: 726 - protein, 419 aa, Unknown
  Obtained from environmental sample
  DOMAIN (2)...(404): FAD dependent oxidoreductase
MKVVVLGAGVIGVTSAWYLSEAGHEVTVVDRQPFAGLETSFANGGQISVSHAEPWANPGAPLNILRWLGREDAPLLFRPRVSPRQWSWGLRFLYECLPGRTRRNTLEILKLALYSHRELKALRAKTGIRYDHSERGILHLHSDPRALDAARHRVELMRDHGFDMQLKTAQQCLEIEPALKYTLASLAGGTYAPSDESGDAHQFSRQVEELCRRAGVAFAFQSTAQRLLLEGGRITGIRIRHVEGPEQTLRADAYLMCMGSFTPFLVEPAGVRLPVYPVKGYSVTIPVPPEADGAPLVCLSDEAGKLAISRLGNRLRVAGTAELNDYDSSINPYRCAAILARAEELFPRGGAFDRAQPWAGLRPATPSNVPVIGRTRLSNLYLNTGHGTLGWTLACGSGRAIADIISGRRPDVDFAFRGG

SEQ ID NO: 727 - DNA, 1329 bp, Unknown
  Obtained from environmental sample
atgcatatcgtcgtgatcggcgcaggggtgatgggtgtgaccacggcttatgccttgagtcagcgtggtcacagggttacggttatcgagcagttatccagtgccgggcaggagaccagccgggccaatgccgggcagcgcagctatggctatgtctatccctggtcctctccggcgatgatcaaaaaggcgctgccctggctgttgcagaaggatggcccattgaagatgcagatgccgccgagccttgacgcgctgcgctttctgtttgccacctggcgttatgcaaaaccgggtatcttcgaggccaacaagcgcgccatgttgcaactggccgcctacagtcgtgagtgcttccataccctggaggccgaactctcgctggcgtttgatggtgaacagggtggggtgatggagctggccagtgatgcggccagtgcagcgagtctgcagtcagccttgccgttgctgcgcgaagtcggcgtgccacatcgcttcctgagcgcggaggaaaccctggcgcaggaaccggccttggcagggcatggccctttgctgggtgcgctgtggttgccggaggatggcaccggcgactgctgccacttcagtcaggcgctggcggctgcctgtgagtctcggggtgttgagtttcgctacaacacgcgagtggtttctgcagagctggagcgtgagcaggtggtcggattgatgctcaggccttctgatgaggatcaggtatattcagggccaaagtcaaaacaagagtcagaacccggctctgaacaggcgccagaactgttgcaggcggatgcctatgtgctctgtgctggaaccgagtccaaccgtctggggcaactgttaggcagtcggctgatgatctacccggtcaagggctactcactgaccgccccgctgctcgaccctgataaagcgccgcgctactcggtgatcgatgatcgcttcaaggtggtcacgacacggctgggttcgcggatgcgcgcgaccggctttgtcgagctgaccggtatgaatcgcgagatacccgaggcgcgtctggatacgattcgccgtgccgtggcgtcgcgttttccgggggcagcggatatgagtcaggctgagccctgggcaggatttcgacccatgacgccggatggcccgccgctgatcggtcgtggccagtatcacaacctctatctgaacaccgggcatggcacctttggctggaccctgtcggcggccagtgcacaggtgattgcacaactggtggatggggaggcgccggcagtagcgctggacgctttccgaccggaccggttcgaactggcctga

SEQ ID NO: 728 - protein, 442 aa, Unknown
  Obtained from environmental sample
  SIGNAL (1)...(18)
  DOMAIN (2)...(421): FAD dependent oxidoreductase
MHIVVIGAGVMGVTTAYALSQRGHRVTVIEQLSSAGQETSRANAGQRSYGYVYPWSSPAMIKKALPWLLQKDGPLKMQMPPSLDALRFLFATWRYAKPGIFEANKRAMLQLAAYSRECFHTLEAELSLAFDGEQGGVMELASDAASAASLQSALPLLREVGVPHRFLSAEETLAQEPALAGHGPLLGALWLPEDGTGDCCHFSQALAAACESRGVEFRYNTRVVSAELEREQVVGLMLRPSDEDQVYSGPKSKQESEPGSEQAPELLQADAYVLCAGTESNRLGQLLGSRLMIYPVKGYSLTAPLLDPDKAPRYSVIDDRFKVVTTRLGSRMRATGFVELTGMNREIPEARLDTIRRAVASRFPGAADMSQAEPWAGFRPMTPDGPPLIGRGQYHNLYLNTGHGTFGWTLSAASAQVIAQLVDGEAPAVALDAFRPDRFELA

SEQ ID NO: 729 - DNA, 1098 bp, Unknown
  Obtained from environmental sample
ttcggcacgagtgccggcgtgaagttctgcgccgcctatccgattaccccttcgaccgagattcaggaatggctggccgcgcatctgcccgaggtcggcggggttctggtccaggccgaggacgaactggcatcgatcaacatgtgccttggcgcctcgtttggcggtacgccggccatcaccgccacatccgggccgggtttctcgctgatggtcgaggcgctgggcctggccaccgccaccgaaacaccactggtggtgatcaacgtgatgcggggcggcccgtcgaccggcattccgaccaagtccgagcaggctgacctcgacgttgccgtgcacggcgcacacggcgacgcaccacggctggtatttggcgccaacagcatcggcgactgcatgagcaccacccaatgggcggtgcatctggccgaacatctgcaggtgcccgcggtggtcttgagcgaccagctcctgggccaggcgcgcgccgcgatcccgccgccacggccgcgcgactggcatgcccggcgcgacctgcccgtcttgcccgcggacgactacgagcgttttgccgataccggcagcggcatctcgccgatgagcctgcccggcatgcccggcggacagtacaccgccaccggactcactcaccggaccaacgcccggccttcggccatgaccaacgaccatcagctccagctcgacaagcgccggcgcaagcttgccagccatgactttggcgagtactgggccgacatcgagggagaaggcgagatcggtgtgctgacctggggctcatcgacattgcctgcgcgcgaagcgctcagtcgctgccgtgaagagggcatcgccgcgcgcctggtttcagtgcgcctgctcagtccgcttccgatcgaaccgctgctggccgcgctggccggctgcaagcggctactggtggtggagcagagtcattcggcccagtttcaccgctatctcaggtcgatgatcgacctgccggcacacacaagggcattccatcggcccgggccgttgatgctcactcccggcgagatcgccggacagatccgcgccatcgccctggagcaagccgcatga

SEQ ID NO: 730 - protein, 365 aa, Unknown
  Obtained from environmental sample
  DOMAIN (5)...(236): Pyruvate flavodoxin/ferredoxin oxidoreductase, thiamine diP-binding domain
FGTSAGVKFCAAYPITPSTEIQEWLAAHLPEVGGVLVQAEDELASINMCLGASFGGTPAITATSGPGFSLMVEALGLATATETPLVVINVMRGGPSTGIPTKSEQADLDVAVHGAHGDAPRLVFGANSIGDCMSTTQWAVHLAEHLQVPAVVLSDQLLGQARAAIPPPRPRDWHARRDLPVLPADDYERFADTGSGISPMSLPGMPGGQYTATGLTHRTNARPSAMTNDHQLQLDKRRRKLASHDFGEYWADIEGEGEIGVLTWGSSTLPAREALSRCREEGIAARLVSVRLLSPLPIEPLLAALAGCKRLLVVEQSHSAQFHRYLRSMIDLPAHTRAFHRPGPLMLTPGEIAGQIRAIALEQAA

SEQ ID NO: 731 - DNA, 1260 bp, Unknown
  Obtained from environmental sample
atgcatgtaatcgtcatcggcgcaggcgtggttggcgccgccacgaccctggccctggtcgagcgcggtgtgcgcgtgaccctgatcgaccgccgccctgaggctgccgccgaaaccagccacgccaatggcggcggcatcacgccgttgcattccgaaccatggaacgcgcccggacttttgggcaagctggtgcacaatgtcgggcgtcccgattcgccctacaagctctatccgctggccgtaccgggcatgggcctgtggggagcgaagtttctggtgcacatgcgcaagacccgattcgtcgccaatgcccggcgcaacttcaggctgggcctgtattcactcgactgcctgcggcgctgggtccagacctacgacattgatttccaccgcgccagcaacggatcgttgcaggtctatttcgaccccgagctgctcgaccaggccatgcgcctgcgcctcgagttgctcgacggcctggcgccggtcgagcgaatcggggccgaccaggccatcgatcgcgagccggccctggcgccggtcggtaaccggctggccggggcaatcctgtttcctgatcacgaatgcggcgatgcctgcctgttcagtcagggcgtggtccgaatcgccgaaaggatgggcgccgaattgcgcctttccacacgggttaccggaatcatccgtgaccgggacgggttccgggccgtggataccgaccatggccgcttccaggccgatgcctgcgtactggctgccggcccggatgcggcgaagctggcgcgcagcgcgggtgtgcggctgccgatctacccggtgcgtggctattcggcgaccttcgaactcgatgaccccgggccggccccgcacatgccgatgctcgacatggccagtcgctttgtgacgctgcgcctgggcgagcggcgcctgcgcgtggccggcctggccgattttgccggccatcgcaaggacattcccggccatcgaatcgaatccctgcttgccggagcgcgcaagctgctgccggcacttgccgatgagctggtcaccgaacgggccgggttgtgggccggcctgcggccggtcacgcccgatggcctgccgctgttgggtccatccagggtcaggggcttgtacgtcaatgccgggcatggcccgatgggctggaccatggcctgcggttcggcgcgcgtgctggccgacctggtcgccggcaaatcacctgaaatcgacgtgcgcgactttgccgttcatcgctga

SEQ ID NO: 732 - protein, 419 aa, Unknown
  Obtained from environmental sample
  DOMAIN (2)...(402): FAD dependent oxidoreductase
  SITE (137)...(140): N-glycosylation site. Prosite id = PS00001
MHVIVIGAGVVGAATTLALVERGVRVTLIDRRPEAAAETSHANGGGITPLHSEPWNAPGLLGKLVHNVGRPDSPYKLYPLAVPGMGLWGAKFLVHMRKTRFVANARRNFRLGLYSLDCLRRWVQTYDIDFHRASNGSLQVYFDPELLDQAMRLRLELLDGLAPVERIGADQAIDREPALAPVGNRLAGAILFPDHECGDACLFSQGVVRIAERMGAELRLSTRVTGIIRDRDGFRAVDTDHGRFQADACVLAAGPDAAKLARSAGVRLPIYPVRGYSATFELDDPGPAPHMPMLDMASRFVTLRLGERRLRVAGLADFAGHRKDIPGHRIESLLAGARKLLPALADELVTERAGLWAGLRPVTPDGLPLLGPSRVRGLYVNAGHGPMGWTMACGSARVLADLVAGKSPEIDVRDFAVHR

SEQ ID NO: 733 - DNA, 1257 bp, Unknown
  Obtained from environmental sample
atgcatgtcatcgtgattggcgccggggtggtgggctcgaccaccgcactggccctggctgaacgcggacttgaagtcacgttgatcgagcgccacggcgaaccgggtgccgagaccagtcatgccaacggtggtggcatcacaccgggccatgccgaaccgtggaattcgccaggcattatccgtcgcctgctgacccgctccggcgagggcgagccgtttcgtatccggcctggagccctgccgggactgtccggctggggcctgcgctttctggccaattcgcgtcccggccgctactacttcaatgcgcgggccaacacccgcctggcggtatattccggtcactgtttgaaagccctgcgcgagcgattcgagctgaactatcaccaatacaccgatggttcgctggagctttacttcagccaggccgaactggaccacgccctggagttgcgtcgccgaatcggtgatccgggtgtggagattcacctgcttggcgttcgcgaagccgtggcgctggagccggcgctggagccgatcgccgcccgactggtcggggccatgcaattgccactgcacgaatccggcgatgcctgcgagttttccgccgaaatggtgcgttgcgcccgcagtctgggcgcgcgcgtcctgttcgataccgaagtggtcaccatcaaccggaacaacgaccggatcagtggggtgcagacggacaaggaaaccatcaacaccgatgcggtcgtgctgtcagccggttgcgccagcccgagcctggcccggccgctgggcttgcgactgccgatctatccggtcaagggctactcagccaccctcgaactcgaccaggttgaactggccccgaccatgccgctgctggatctggagcaacgcattgtcaccgcccgctatggccgacgattgcgcatggccgggctggcagatttcgagggccatgaccgaagtgttcgtcccgaacgaattgcccgcctgctcgaatcggcggccaccctgctgccggcactggccgatgaaattcactccggaaaggccgaaccctgggcgggacttcgccccatgacccccacgggcccaccgatgctcggcccgacccggattcccggactgtatctgaacaccggtcatggctccatgggttggacccaggcggccggctcggccgaagtcctggccgatctggtgaccggaaaaacgccggtgatcgacatgagggggttggaggcggtaaaaggttga

SEQ ID NO: 734 - protein, 418 aa, Unknown
  Obtained from environmental sample
  SIGNAL (1)...(18)
  DOMAIN (2)...(400): FAD dependent oxidoreductase
MHVIVIGAGVVGSTTALALAERGLEVTLIERHGEPGAETSHANGGGITPGHAEPWNSPGIIRRLLTRSGEGEPFRIRPGALPGLSGWGLRFLANSRPGRYYFNARANTRLAVYSGHCLKALRERFELNYHQYTDGSLELYFSQAELDHALELRRRIGDPGVEIHLLGVREAVALEPALEPIAARLVGAMQLPLHESGDACEFSAEMVRCARSLGARVLFDTEVVTINRNNDRISGVQTDKETINTDAVVLSAGCASPSLARPLGLRLPIYPVKGYSATLELDQVELAPTMPLLDLEQRIVTARYGRRLRMAGLADFEGHDRSVRPERIARLLESAATLLPALADEIHSGKAEPWAGLRPMTPTGPPMLGPTRIPGLYLNTGHGSMGWTQAAGSAEVLADLVTGKTPVIDMRGLEAVKG

SEQ ID NO: 735 - DNA, 807 bp, Unknown
  Obtained from environmental sample
aaagaattcggcacgagcatcagtgcggccacattggcgcttgccgcccgaccggcccaaagctggaccgcacttgtggccaccgcctcgctcaagtccggactcgagttgttgaaacgattgcgaaaacacatgggcgagaccctgtcggcctgtgaattcatgccgcgcctggccatggagttcgtgctcgagtacctgggttcggcccgcgatcccttcaatgggccgcatccctggtatgtgctggtccaagtcgacagcgccatggatggagactggctggagacgcgcttgctggacatgctgcaggacaccctgtctgaaaaaatcatcagcgatgtcgtggtcgctgacagcatggccaaagccggtcagctttggcggctgcgtgaatcgatctcgcccgcccaacaaacaggtggcgccagtctgaaacacgatatttccgtaccggtgtcaagcattccggccttcgtcgaccaggccagcagtgatctggccaaggcggttccggggattcgaccgtgcatcttcggccacctcggcgacggcaacctgcacttcaacctcagccagcccgaggccatgcaagccgatcaattccgcgcactggaaagtcgctgcaaccgcatcgtgttcgaccttgtccgacaattcaacggctccatcgccgccgaacacggcattggccaattgcgtcgcgaagaattggccaccggccagccactgaaggtcgacctgatgcgcgccctgaagaagtcactggacccgcacggcctgctcaaccccggaaaggtcgtctga

SEQ ID NO: 736 - protein, 268 aa, Unknown
  Obtained from environmental sample
  SIGNAL (1)...(21)
  DOMAIN (17)...(267): FAD linked oxidases, C-terminal domain
  SITE (192)...(195): N-glycosylation site. Prosite id = PS00001
  SITE (224)...(227): N-glycosylation site. Prosite id = PS00001
KEFGTSISAATLALAARPAQSWTALVATASLKSGLELLKRLRKHMGETLSACEFMPRLAMEFVLEYLGSARDPFNGPHPWYVLVQVDSAMDGDWLETRLLDMLQDTLSEKIISDVVVADSMAKAGQLWRLRESISPAQQTGGASLKHDISVPVSSIPAFVDQASSDLAKAVPGIRPCIFGHLGDGNLHFNLSQPEAMQADQFRALESRCNRIVFDLVRQFNGSIAAEHGIGQLRREELATGQPLKVDLMRALKKSLDPHGLLNPGKVV

SEQ ID NO: 737 - DNA, 1242 bp, Unknown
  Obtained from environmental sample
atggcccgcaaaatcatcgttcttggtgccggcatggtcggcgtatccgtagcctggcatctggtgcgtcgcggtcatgacgtcacgctggtggaccgccgcgaaccgggcctcgagacctccttcggcaatgccggcatcatccagcgcgaggcggtgcgcccctacgccttcccccgtgatgtcgccaccctgctgcgggtggtgcccaaccgccaggtggacatccgctaccgtcccaccggcatgctcagcgcggcgggcccgctgctgaactactggctgaactcgagcggtaagcgctacgagcgcatcgtgaccgagtgggcatcgctgatcatgcgctgccaggatgcccacgcgccgatgatcgaagccgccggcgccgaggcgctggtgcgcaaaggcggctggctggagctttaccgcacccagaaggagttcgaggagcgccagaaagaagctcaggaaaaccacgagcgcttcggggtcgagtttgaagcgctggacgccgaggcgctctacgccaaggagccgcatctggccaaggggctggtcggggcgatccactggacgcagccctggatggtctcagacccgggcggcctggtgcaggcctacgcccgcagctttgccgcacagggcggccaggtgaagcaggccagcgtcgaggatgtgctccaggtagagggcggctggcgagtcaataccagcgaaggccccatggaggcagagcaggtggtggtggccctgggcccctgggccggagaactgctgggcaggctgggcatgaaagtgccgctgttcgtgaagcgcggctaccacatgcactactccgccgaaggggaagccaagctcaaccactgggtgatggatgccgagaggggcttcctgctcgaaccgatgcgcgccggcattcgcctgaccaccggcgccgagctggccgacctggaatcaccgccccagtacaagcagctggccgccgccgagaaggtggcccgcaagctgttcccgctgggcaagcgtcgcgacagccagccctggaaaggcgcccgcccctgcctgcccgacatgaagccagtgatcggccccgcccccaacaaggaagggctgtggctcgcctgcggccacggccaccagggcttcaccctgggcccggccaccggcgaactgctcgcccagatgatggatggcgaagagcccgcggtggatatggcaccgttccgggtcgatcgattctga

SEQ ID NO: 738 - protein, 413 aa, Unknown
  Obtained from environmental sample
  DOMAIN (4)...(395): FAD dependent oxidoreductase
  SITE (97)...(100): N-glycosylation site. Prosite id = PS00001
  SITE (239)...(242): N-glycosylation site. Prosite id = PS00001
MARKIIVLGAGMVGVSVAWHLVRRGHDVTLVDRREPGLETSFGNAGIIQREAVRPYAFPRDVATLLRVVPNRQVDIRYRPTGMLSAAGPLLNYWLNSSGKRYERIVTEWASLIMRCQDAHAPMIEAAGAEALVRKGGWLELYRTQKEFEERQKEAQENHERFGVEFEALDAEALYAKEPHLAKGLVGAIHWTQPWMVSDPGGLVQAYARSFAAQGGQVKQASVEDVLQVEGGWRVNTSEGPMEAEQVVVALGPWAGELLGRLGMKVPLFVKRGYHMHYSAEGEAKLNHWVMDAERGFLLEPMRAGIRLTTGAELADLESPPQYKQLAAAEKVARKLFPLGKRRDSQPWKGARPCLPDMKPVIGPAPNKEGLWLACGHGHQGFTLGPATGELLAQMMDGEEPAVDMAPFRVDRF

SEQ ID NO: 739 - DNA, 1245 bp, Unknown
  Obtained from environmental sample
atgtctcgtcaaaccgtcgtcctgggagccggcatggtcggcgtttccatcgcctggcacctggcccgtcgcgggcgttcggtgctgctggtggatcgccttccgcccggtcgcgagacctcctatggcaacggcggcctaatccagcgcgaagcggtgcgcccctacaccttcccccgcgagctgggcaagctgctcgattcgctgcccaaccggcgggtcgacattcgctatcagtggcgcggggtgctgcagttcgccgggccgctgctgggctactggcgccattcggctccccgccgctacgctcgcatcgtttccgagtatgcctcgctgatcgcgctgtcgacccaggagcatgcgccgatgatcgaagccgccggggcaggagagctgatcggcaaggagggttggctcgaggtgcatcgcagccaggcggaactcgaccgtcgggccctcgaggcggaggattccgcccggcgtttcggcgtgacctacgacgtgctcgacggccggggcctggcgcacaaggagcctgctctcggcgatgggctggccggggcggttcactggaccaactcctggagcgtggccgacccgggcggactggtggctgcctacgcccgcagcttccagcaactggggggagagatcctgcaggcggaagtcggcagcgtgagccaggcgggcgccggctggcacgtcgacaccgaccggggcggtctcgaggccggcgatctggtggtggccctggggccgtgggcgggcgcctggctgagggatcttggctaccacctgccgaccttcgtcaagcgcggctaccacatgcactacggtgcggcggaggagcagcgcatcaaccattggctggccgatgccgacatcggctacatcctggcgcccatgcgggccggcattcgtctgaccaccggggcggagctggctccgctggatgcgccgcccgcccacgatcagttggcggcagccgagcgtcgagcgcgcgagctctttcctggcctggggcagcgcctggaggagcagccttggaagggtgcgcgcccctgcctgccggacatgaagccggtgatagggccggcgccgcagcatgcggggctgtggttcgccttcggccacgggcaccagggcttcaccatggggccggccacggggcgcgtgctgagcgagatgatggaaggggagccgacggcggtggatatggcgccctttcgcgccgaccggttttga

SEQ ID NO: 740 - protein, 414 aa, Unknown
  Obtained from environmental sample
  DOMAIN (4)...(396): FAD dependent oxidoreductase
MSRQTVVLGAGMVGVSIAWHLARRGRSVLLVDRLPPGRETSYGNGGLIQREAVRPYTFPRELGKLLDSLPNRRVDIRYQWRGVLQFAGPLLGYWRHSAPRRYARIVSEYASLIALSTQEHAPMIEAAGAGELIGKEGWLEVHRSQAELDRRALEAEDSARRFGVTYDVLDGRGLAHKEPALGDGLAGAVHWTNSWSVADPGGLVAAYARSFQQLGGEILQAEVGSVSQAGAGWHVDTDRGGLEAGDLVVALGPWAGAWLRDLGYHLPTFVKRGYHMHYGAAEEQRINHWLADADIGYILAPMRAGIRLTTGAELAPLDAPPAHDQLAAAERRARELFPGLGQRLEEQPWKGARPCLPDMKPVIGPAPQHAGLWFAFGHGHQGFTMGPATGRVLSEMMEGEPTAVDMAPFRADRF

SEQ ID NO: 741 - DNA, 1245 bp, Unknown; identical to SEQ ID NO: 739
  Obtained from environmental sample

SEQ ID NO: 742 - protein, 414 aa, Unknown; identical to SEQ ID NO: 740
  Obtained from environmental sample
  DOMAIN (4)...(396): FAD dependent oxidoreductase

SEQ ID NO: 743 - DNA, 1242 bp, Unknown; identical to SEQ ID NO: 737
  Obtained from environmental sample

SEQ ID NO: 744 - protein, 413 aa, Unknown; identical to SEQ ID NO: 738
  Obtained from environmental sample
  DOMAIN (4)...(395): FAD dependent oxidoreductase
  SITE (97)...(100): N-glycosylation site. Prosite id = PS00001
  SITE (239)...(242): N-glycosylation site. Prosite id = PS00001

SEQ ID NO: 745 - DNA, 1146 bp, Unknown
  Obtained from environmental sample
atgacccattccgacatcctgattattggcggcggcatcgccggtatgtctgcggcattctttctggcaaagaccggaaagtccgtcacggttctggaacgcgaagaccagcccgggtatcacagcaccggccggtctgcggctctgtatagcgaaacctatggccccaaaatcattcgcaagatgtcgacggcaagccgggatttcttcatcgccccgcccgacgggtttaccgaccacccgatcctgaccccgcgcggcatcatcatgaccgccgcccccggcgaagaagccaaacttgacgaaatcctgaccgaaggccgcgcaaacggggcaaattttgtttccctgaccccggccgagctcaaagaaatcatcccggtgatcaataccgatctgattgccagtgcggcccatgaaactgatgccatggacatcgatgtccatgcgctgcattggggctttatccgccagttcaaatcactgggcggtacgctgatcaccaaggctgatgtcagtgcgatcagcaaaacaaatggcacatggcaggtaacccttggcaatgggcaaacgcacagcggtgatatcatcgtcaatgccgcaggcgcatgggtcgatgacatcgccaccaaggccggtatcaaaccgcttggcattacgcccaaacgccgcacagccgtgatggtggatttgccagccgatgtgaatgcccatggctggccactggtcgccagccttgatgaaagcttgtatttcaaggaagacgccggacggttgctggtctcccccgccgacaccaccccgaccgaaccccatgatgtccagcccgaggaactcgatatcgcgatcacgattgaccggctgatgaccgcaaccagcatcgaagtccgccgtcccggagaaagctgggccgggttgcgcagcttttttgccgatggcgatccggtttcagcatttgatccggccgatggcagtttctattggctggccggtcagggcggatatggcattcaaaccgcaccggccatgggggaatatgccgccagcctgatctgtggcaacggcatcccggcccatatgcaaaagcttggcattaccgaggatgcgctctcggcaacccgcccgtcgctggtgaccgggaaataa

SEQ ID NO: 746 - protein, 381 aa, Unknown
  Obtained from environmental sample
  SIGNAL (1)...(23)
  DOMAIN (5)...(350): FAD dependent oxidoreductase
  SITE (131)...(134): N-glycosylation site. Prosite id = PS00001
  SITE (181)...(184): N-glycosylation site. Prosite id = PS00001
MTHSDILIIGGGIAGMSAAFFLAKTGKSVTVLEREDQPGYHSTGRSAALYSETYGPKIIRKMSTASRDFFIAPPDGFTDHPILTPRGIIMTAAPGEEAKLDEILTEGRANGANFVSLTPAELKEIIPVINTDLIASAAHETDAMDIDVHALHWGFIRQFKSLGGTLITKADVSAISKTNGTWQVTLGNGQTHSGDIIVNAAGAWVDDIATKAGIKPLGITPKRRTAVMVDLPADVNAHGWPLVASLDESLYFKEDAGRLLVSPADTTPTEPHDVQPEELDIAITIDRLMTATSIEVRRPGESWAGLRSFFADGDPVSAFDPADGSFYWLAGQGGYGIQTAPAMGEYAASLICGNGIPAHMQKLGITEDALSATRPSLVTGK

SEQ ID NO: 747 - DNA, 1278 bp, Unknown
  Obtained from environmental sample
ttgaaaattgtcgttgtaggcgctggcatcataggcgtcaccaccgcgtatgaattggccacgcgcggccatgaggtcactttactcgacgggcgggcaggggcggggcttgagacgagctacgccaatggcggtcaactcggtgcgagcgaagtcgcgccttgggcggggccggaagtgccgtggctggtgctgcgttggcttggccgtgcggatgctcctttcaggttgaaactgaaatcggatccggagcaatggctctggctgatgcgtttcctcatgcgctgccgcaaatctgcgcgcgccgaacgcgtcatgcccaatctcgctctggcgctactgtctcagtcgcgcatggacgagatcgcgctgcaaatgaacaacgatccgatagactatgacgaacggcgtgatggcatcctccagattttccatcgcgaacggagcctgaaagaagccgcgtcatccatcgacacgatgcaggatgcaaggctggagcaacgagtgatgtcggcgcgcgaatgcgtcgatctggagcctgctcttgaggaggcgtttgcccggggcaatattgtggggggcatattctgttccagcgaccgcagcggcgatgctcacaaatacacacatcaattggcagagcgcgcgcaacaactcggcgtagcctttgttggagaagctgaggtgacgggctttgaaacgtctggggaccgtattaccggtgtacaaacccgtgcctggacgttcaatgcagacgctgtcgttcttgcagccggtgttcacaccgcgcgacttgcgcgcatgtgcggcacacggataccggtctatccgctcaagggttattcggtgactttgccaacagatggcatcaaggcgccgcgggtgagcctcaccgacgaagcccgcaaggtggttgtcagtcgtctgggcgatcgattacgcaccgccggtacggcagaagtaagcggctatgataccgagatcgaactggctcgcgctcgctcagtgctggatgccaccacggatatttttccacaaatgaagccggtcgaagacaaggccgaatattggacaggtctgcgtcctatgacgcctgatggaagcccgattcttgggcaagccgggcagttcaataatctctatctcaacacaggccacggctcattgggctggacaatggcggctggcagcgccgtaggcgtcgcagacgcaatctgcggcagggtgtctcagctggatctaacccctttcagcataacaagattttcgcttatctga

SEQ ID NO: 748 - protein, 425 aa, Unknown
  Obtained from environmental sample
  DOMAIN (2)...(404): FAD dependent oxidoreductase
  SITE (259)...(269): Regulator of chromosome condensation (RCC1) signature 2. Prosite id = PS00626
MKIVVVGAGIIGVTTAYELATRGHEVTLLDGRAGAGLETSYANGGQLGASEVAPWAGPEVPWLVLRWLGRADAPFRLKLKSDPEQWLWLMRFLMRCRKSARAERVMPNLALALLSQSRMDEIALQMNNDPIDYDERRDGILQIFHRERSLKEAASSIDTMQDARLEQRVMSARECVDLEPALEEAFARGNIVGGIFCSSDRSGDAHKYTHQLAERAQQLGVAFVGEAEVTGFETSGDRITGVQTRAWTFNADAVVLAAGVHTARLARMCGTRIPVYPLKGYSVTLPTDGIKAPRVSLTDEARKVVVSRLGDRLRTAGTAEVSGYDTEIELARARSVLDATTDIFPQMKPVEDKAEYWTGLRPMTPDGSPILGQAGQFNNLYLNTGHGSLGWTMAAGSAVGVADAICGRVSQLDLTPFSITRFSLI

SEQ ID NO: 749 - DNA, 1245 bp, Unknown
  Obtained from environmental sample
atgcgcgtaatagtgctgggggccggcgtgatcggcgtgacttcggcgtggtatttggcccaggccgggcacgaaataacggtggtggatcgccaaccggatgccggccttgaaaccagctttgccaacggtagccaaatttccgtgtgccatgcggagccctgggccaacccagcagtgttttccaagttgttgcgttggttggggcgggaggatgctcccttgctgtggcgtttccgtttggacccggctcaatgggcctggggacttcgcttcctggctcagtgcggccctacccgaacccggcagaacatcgaggcactggttgcccttggtttgcacagccggaccagtttgcaggtgctccgtacggagttgaacctgcaatacgaccagttggaaaagggcattctgcatttctataccgatgcccgggaatttgagcatgcccgtccccaggcggaactcatgactcaactgggctgtccccgtcgggtagtttccacggctgaatgtctggctctggagccggcattgcaacacattgggccgaagattgtggggggcacctacaccccggatgacgagtcgggcgatgcgcggaagttcacccagcagttggcccagcgctgtgtttctgcgggtgtcgtattccgttatgggagcacgattgccgccatccaggctgaggccgggaaaatcagcggggttcgcctggccggcggcgaagtgttggcggcagatgcctacgtattggcgttaggcagctatgcaccactattgacggcttccttgggcatgtccttgccggtgtatccggcgaagggttactccatcactattcccttggccgaggggagcgaggcgccgatggttagtctcaccgacgacggttacaagctggtgtattcccgcctcgggcaacgcttgcgggtggccgggacggcggaattctgtggctacgataccagcctcaaccgggcaaggctggaggccttgaaggtgcggacgaaggaggtttttcccactttgaaggcggctggcgaaatcgaagaatggaccggcttgcggcccgctacgccggggaacgtgcctttggttggtgccagccgttattccaatcttttcctgaatgtcggtcacggcaccctggggtggaccctggcctgcggttcggggcagttgctggctgacctagttagcgggaaggcaccggcaattgacccggttcgttatcggccctga

SEQ ID NO: 750 - protein, 414 aa, Unknown
  Obtained from environmental sample
  DOMAIN (2)...(399): FAD dependent oxidoreductase
  SITE (43)...(46): N-glycosylation site. Prosite id = PS00001
MRVIVLGAGVIGVTSAWYLAQAGHEITVVDRQPDAGLETSFANGSQISVCHAEPWANPAVFSKLLRWLGREDAPLLWRFRLDPAQWAWGLRFLAQCGPTRTRQNIEALVALGLHSRTSLQVLRTELNLQYDQLEKGILHFYTDAREFEHARPQAELMTQLGCPRRVVSTAECLALEPALQHIGPKIVGGTYTPDDESGDARKFTQQLAQRCVSAGVVFRYGSTIAAIQAEAGKISGVRLAGGEVLAADAYVLALGSYAPLLTASLGMSLPVYPAKGYSITIPLAEGSEAPMVSLTDDGYKLVYSRLGQRLRVAGTAEFCGYDTSLNRARLEALKVRTKEVFPTLKAAGEIEEWTGLRPATPGNVPLVGASRYSNLFLNVGHGTLGWTLACGSGQLLADLVSGKAPAIDPVRYRP

SEQ ID NO: 751 - DNA, 912 bp, Unknown
  Obtained from environmental sample
ttgccgcgcacggtacgatttgggaaggcgcttgtggaaaaacattatcaggttgtcatcgtcggcggtgggccggtgggcatggcgctcgccatcgatctcggattacgcggcatctcctgcgcattgatcgaaagccggaccaagggacacttgatcccgaagggccagaaccttacccagcgcacgctggaacatttttacttctggggcatcgtcgatgaattgcgcgcctcgcgtgtcatgccacgcgacgccgcgatcggcgagatcacggcctatggggatctcaccagtgaatactggcaggcggcggcgggccgcgagatcgtgcggccttactacttccaggacaacgaccgcatgccgcagtaccagatggaagcggtaatggcggcgaaacttgcgtcgatgaagaatgtcgatgtgcggatcggctggtcggccgtggccgtcgaacaggatgcgggcggcgcgaaggtcgagattgcggaagaggctggtccgggccgcgacgttttcagcgcggaatacgttgtcggttgcgacggcgcgcgttcgctggtgcgcgagcaggccggcatttcccgcagcggcacggtgttcgataagctcatggtgctgatggtgttccgctcgcgcgaactgcacgagcggctgaagcgctttccgcagcgctccgtctatcgcgtgatgcatccggatttcgaaggctactggcagttcttcggccgtatcgatgtcggtgagagcttctttttccatgcgccggtgccgcgcgacaccaaacgcgaaaacttcgatttcatggggccgctgcgccgcgccgccggtttcgatttcaagaccgagttcgactacaccggcttctgggagctgcgcaacgaagtcgccgagatctactcgtgccga

SEQ ID NO: 752 - protein, 304 aa, Unknown
  Obtained from environmental sample
  DOMAIN (15)...(302): FAD binding domain
  SITE (58)...(61): N-glycosylation site. Prosite id = PS00001
MPRTVRFGKALVEKHYQVVIVGGGPVGMALAIDLGLRGISCALIESRTKGHLIPKGQNLTQRTLEHFYFWGIVDELRASRVMPRDAAIGEITAYGDLTSEYWQAAAGREIVRPYYFQDNDRMPQYQMEAVMAAKLASMKNVDVRIGWSAVAVEQDAGGAKVEIAEEAGPGRDVFSAEYVVGCDGARSLVREQAGISRSGTVFDKLMVLMVFRSRELHERLKRFPQRSVYRVMHPDFEGYWQFFGRIDVGESFFFHAPVPRDTKRENFDFMGPLRRAAGFDFKTEFDYTGFWELRNEVAEIYSCR

SEQ ID NO: 753 - DNA, 1248 bp, Unknown
  Obtained from environmental sample
atggcacgtaccgatgcaatcgttctgggcgccggcattgtcggcacgtcggtcgcgctgcaccttgtgaaacgcgggctttcggtcgcgctgatcgaccggcgcgggccgggcgaggagacgagctacggcaacaccggcgtcatcgtcggcgcgagcgtgttcccgacggcgtttccgcgcagcctgaagaagctcattcaggtggcgctcaagcaggcgccggaggcgaactatcaccttagggacctgctcaaggtcgcgccctggctgatctcgtatttcaatttctccacgcccgagaagctcaaggagagcgccgtcaagctgcggccgctgatgagccattcggtcgccgagcacaaggtgctgctcgaagagtccggcgcgatgaaatatttccgcgagaccggctggatcacgctctatcgttccgacgcggccttcgaggcgatgcagccgcagctcgagttcggcgcgaagatcggcgttgcggcgcaggcgttggatatgaacggcacgctcgcgctcgagccgagcctcaatccggtgttccgccacgcgctgatgtggccggacgtcgcctcgctctccaatccgctgatggtgacgcgcgcctatgcgaagcgtttccaggcgctcggtggcgtgctgctcaagggcgacgcccgcaaggtgcatcgcgccgagggccgctggcgcgtcgacaccgaggaagggcccgtcgattcggcgaatgccgtggtggcactcgggccgtggtcgcccgacgtgctcgagccgctcggcatcaaggtgccgctcggcatcaagcgcggctatcaccggcatttcaacgcgaagggcaacgccgcgctgtcgcggccgatcatcgataccgagatcggctatgcgctgacgccgatggagcaggggatccggctgacgactggcgccgagttcgccgaccgcgatgcgccgccgacgccggtgcagttcgaccggctgatgccgcgcgccaaggagctgtttccgctcggcgagccgaacgaggccgagccctggctcggccgccgcccgaacatgccggactcgctgcccgtgctcggccgcgctccggggcaggacgggctctggctggcgttcggccacggccactgggggctgacgatggcgggggtgacggggcggctgatcgccgagctgatgaccggtgcgacgccgttcgtcgatccgacgccatatcgggcggagcggttcggttcttag

SEQ ID NO: 754 - protein, 415 aa, Unknown
  Obtained from environmental sample
  DOMAIN (5)...(395): FAD dependent oxidoreductase
  SITE (97)...(100): N-glycosylation site. Prosite id = PS00001
  SITE (174)...(177): N-glycosylation site. Prosite id = PS00001
MARTDAIVLGAGIVGTSVALHLVKRGLSVALIDRRGPGEETSYGNTGVIVGASVFPTAFPRSLKKLIQVALKQAPEANYHLRDLLKVAPWLISYFNFSTPEKLKESAVKLRPLMSHSVAEHKVLLEESGAMKYFRETGWITLYRSDAAFEAMQPQLEFGAKIGVAAQALDMNGTLALEPSLNPVFRHALMWPDVASLSNPLMVTRAYAKRFQALGGVLLKGDARKVHRAEGRWRVDTEEGPVDSANAVVALGPWSPDVLEPLGIKVPLGIKRGYHRHFNAKGNAALSRPIIDTEIGYALTPMEQGIRLTTGAEFADRDAPPTPVQFDRLMPRAKELFPLGEPNEAEPWLGRRPNMPDSLPVLGRAPGQDGLWLAFGHGHWGLTMAGVTGRLIAELMTGATPFVDPTPYRAERFGS

SEQ ID NO: 755 - DNA, 1245 bp, Unknown
  Obtained from environmental sample
gtggcacgcacagatgcaatgattttgggcgccggtattgtcggcacatcggtcgcgctgcatctcgcccgacgggggatgagcgttgcgctcgtcgatagagccagcgtcggcgagcagacgtcctatggcaacgccgggatcatcgaaggcaacacaatattcccacccgcatttccatcggatgttggcagccttgtccgcatcgcgctcaagcgcgcgagcgaggcgaactaccacatttcatttctgccgcatgtcctgccgtggttgctggcgttccgcgaagcctcgcggccggagcgcctggcagagaccgcgcgattgatccgtccgctattttcgcgcgcagtcgtcgagcatgagactttgatggccgaagccggagcaacacactacctgcgcaagacgggttggctcaaagtctatcgtgggaaaaagagcgtagctgccttggcaccggaattcgagctcgccgcgaaatttggtttgccactggatgcgctcgacatggccggggcgctggcacttgagccctcgcttcatccggtgttcgcccacgccgtgttttggccggaggcggcgagcgtgagcaatccgctcggcgtgacgcgcgcttatgcggcgcgctttgccgcactcggcggtgtcattctctcaggagatgcgcgatcgttgcaccggacgggaaatcgttggcgggtcgagaccgacgaaggtgcactcgactcagcggagtgcgtcgtcgcattgggtccgtggtcgtcggacttgctcgcgaggtttggtctaagactgccgcttgcggtcaaacggggttaccatcggcattttcgcgcgcaaggtaatgccggtttggcacgcccggttctggacgccgaagtcggttatctggtcacgccgatggaacaaggtatccgcataaccaccggggctgaattcgctgcacgggatgcaccgccttcaccggcccagttcgatcggatcatgcctcgagcgcgccaattgtttcctctgggggagcgcgctgacggaaagacctggcttgggagccgtccttgtttgccggattcgcgaccggtgatcggccgcgctcctgggcaagcgggactatggctcgcgctcggtcacgcccactggggtctcactttaggccccgccacaggacgcatgattgcagagatgatgacgggcgtgccgccattttgcgatcccgctccctatcgtgcggaacgtttcagctag

SEQ ID NO: 756 - protein, 414 aa, Unknown
  Obtained from environmental sample
  DOMAIN (5)...(395): FAD dependent oxidoreductase
MARTDAMILGAGIVGTSVALHLARRGMSVALVDRASVGEQTSYGNAGIIEGNTIFPPAFPSDVGSLVRIALKRASEANYHISFLPHVLPWLLAFREASRPERLAETARLIRPLFSRAVVEHETLMAEAGATHYLRKTGWLKVYRGKKSVAALAPEFELAAKFGLPLDALDMAGALALEPSLHPVFAHAVFWPEAASVSNPLGVTRAYAARFAALGGVILSGDARSLHRTGNRWRVETDEGALDSAECVVALGPWSSDLLARFGLRLPLAVKRGYHRHFRAQGNAGLARPVLDAEVGYLVTPMEQGIRITTGAEFAARDAPPSPAQFDRIMPRARQLFPLGERADGKTWLGSRPCLPDSRPVIGRAPGQAGLWLALGHAHWGLTLGPATGRMIAEMMTGVPPFCDPAPYRAERFS

SEQ ID NO: 757 - DNA, 1251 bp, Unknown
  Obtained from environmental sample
atgcaggacattctcgtgcttggcgccggtatggttggcgtttcaaccgcgctggcgctgcaggggcgcgggcataaggtggtgctggcggacaggaggctaccgggcgaggaaaccagctacggcaatgccggtgtcattcaggccgaggccgcagagccctatgccatgccgcgtgatttgccaacgctcctgcgatatgtgctcgggcagagcaatgatcttgtctggtccccggccggtattgccgtcatggcccctgccctgtggcgctacttccgggcctcagccccggcgcggcaccgggcagtctctgccgtttacagccagctgacggcgcaggcctgcaccgcccatgcgccgctgatcgaggcctccggcagcggcaacctcatagcccgcgaggggctggccattctgcatcgtgatccgaaggcccttgaagctgctgcaagtgaggcgcggcggttgcaggaagcctatggcgtgccgttccgtgctgtggccggtgcggcctggatgcgcgaggagccttccttgcggcaggcgcccgcaggcgtcattcactacacgggcagctggagctgttccgaccctggaggcctcaccaaggcctatgctgcgctctttgaaagccgtggcgggacaatcgccaccgctgatgctgccacgttgcggcggacatcctccggctggcacgtggcgggtgcagaggggccggtcagcgcgcaaaccgtggtgctctgccttggcccctggaccgggcagcttctgaagcgcttcggcatcaccgtgccgatggtgctgaagcgcggctatcacgcccattttcaggcaccgcagatgccccgccgccccttcctggatgcggccaacggcatcgtcgtggcagccatgcgcaagggcttgcgcctctcatcaggggcagcgcttgtggcgcatggcgccaaggctgatccacgccagttgcgccgggctgaggccagcgtcggcgggctgatcgaactggggccgcgcatcgaggagccgcaatggtccggcacccgcccctgccttccgggcatgctgcccatggtgggcccggtgccgcgcgaaacaggcctgtgggtgaatttcggccatggccatcagggctttacattgggcccggtcacggcggatatcctcgcccgtgcgctggacggagagctgaagcaggatgcccccggcagtctgccccatgccctttccccggccatccagctatcctga

SEQ ID NO: 758 - protein, 416 aa, Unknown
  Obtained from environmental sample
  SIGNAL (1)...(19)
  DOMAIN (3)...(392): FAD dependent oxidoreductase
MQDILVLGAGMVGVSTALALQGRGHKVVLADRRLPGEETSYGNAGVIQAEAAEPYAMPRDLPTLLRYVLGQSNDLVWSPAGIAVMAPALWRYFRASAPARHRAVSAVYSQLTAQACTAHAPLIEASGSGNLIAREGLAILHRDPKALEAAASEARRLQEAYGVPFRAVAGAAWMREEPSLRQAPAGVIHYTGSWSCSDPGGLTKAYAALFESRGGTIATADAATLRRTSSGWHVAGAEGPVSAQTVVLCLGPWTGQLLKRFGITVPMVLKRGYHAHFQAPQMPRRPFLDAANGIVVAAMRKGLRLSSGAALVAHGAKADPRQLRRAEASVGGLIELGPRIEEPQWSGTRPCLPGMLPMVGPVPRETGLWVNFGHGHQGFTLGPVTADILARALDGELKQDAPGSLPHALSPAIQLS

SEQ ID NO: 759 - DNA, 1254 bp, Unknown
  Obtained from environmental sample
atgagcgagaccatcaccgaaagcgagatcgtcgtgctgggcgccggcatggtcggcgccgcgaccgccttggagcttcagcgccggggccgccaggtgacgcttctcgaccgcaaggcgcccggcgaggagacgtcctacgggaatgcgggcgtcatcgaggcgagcccctatgttccgctcgcctttccccgggatccgcgcgagatactgcgctttgccggcaatcggcagccagcgcttcatttccattggcgctttctgccccggattgccccttggctgtacgcgttgttccgcaattcctccgaagcccggctgcgcgagaacggcgcggcagtccattcgctgacgacgcacgcgccgaaattgcatgaggaattgctcagcgaggccggcaagacggacctgttgcgcaagacgggctggctccagctctaccggagcgaagcggcgttcaccgccgacggcctgaaacgcgccctcgccgatgaggcaggatgggcctattcagtgctcgacacgcaagccgctacggagcttgagccgcatctgacgccggcgttccacaaggcggtctactggccctcgatctggtcggtcgctgatccgggcgcggcgacgaaggcggtggcggagcttttcgaggggcagggcggccggatcgcccggatggaggtcctggcggtcgagccggtcagtgccggatggcgcgtgaagaccgggcaggccgagattgccgcgcggcacgtcgtggtcgcgctcggcccgtggtcgatggacctgctgcgcccgctcggctaccgctttccgctggccgtcaagcggggctatcacctgcatttccgggccaggggcaatgccactctgtcgcggccgctggtcgaccttgccaatggctacgtgatcaccccgatggggcagggcatccgcttgacgaccggaatcgagttcgctgatcgcgatgcgccccccacgccggtccaggtcgcgcgcgccgaggaggcggcgcgaggcctgttcccgctcgaatcgcccgtcgacccgcaaccctggatggggcgacgcccatgcctgccggactcgcggcccattatcggcccggcgccgcgccatgacgggttgtggctgaatttcggccatgcccatctcggctttacgctgggtccggtgtcggggcacctgcttgcggaaatgatgaatgggggcacgccgatcgccgatccggcacccttcgccgcgacgcgattttga

SEQ ID NO: 760 - protein, 417 aa, Unknown
  Obtained from environmental sample
  DOMAIN (9)...(399): FAD dependent oxidoreductase
  SITE (102)...(105): N-glycosylation site. Prosite id = PS00001
  SITE (291)...(294): N-glycosylation site. Prosite id = PS00001
MSETITESEIVVLGAGMVGAATALELQRRGRQVTLLDRKAPGEETSYGNAGVIEASPYVPLAFPRDPREILRFAGNRQPALHFHWRFLPRIAPWLYALFRNSSEARLRENGAAVHSLTTHAPKLHEELLSEAGKTDLLRKTGWLQLYRSEAAFTADGLKRALADEAGWAYSVLDTQAATELEPHLTPAFHKAVYWPSIWSVADPGAATKAVAELFEGQGGRIARMEVLAVEPVSAGWRVKTGQAEIAARHVVVALGPWSMDLLRPLGYRFPLAVKRGYHLHFRARGNATLSRPLVDLANGYVITPMGQGIRLTTGIEFADRDAPPTPVQVARAEEAARGLFPLESPVDPQPWMGRRPCLPDSRPIIGPAPRHDGLWLNFGHAHLGFTLGPVSGHLLAEMMNGGTPIADPAPFAATRF

SEQ ID NO: 761 - DNA, 1242 bp, Unknown
  Obtained from environmental sample
atggcccgcaatatcctcgttcttggtgccggcatggtcggcgtatcggtggcctggcatctggtgcgccgcggccatgacgtcaccctggtggaccgccgcgagccgggcctcgagacctccttcggcaatgccggcatcatccagcgcgaggcggtgcgtccctacgccttcccccgggatatcgccaccctgctgcgggtggtgcccaaccgccaggtggacattcgctaccgccccaccggcatgatgagtgcggcgggcccgctgctgaactactggctgaactcgagcggcaagcgctacgagcgcatcgtgggtgagtgggcgtcgctgatcatgcgctgccaggatgcccacgcgccgatgatcgaggccgccggcgccgaggcgctggtgcgccagggcggctggctggagctttatcgcacccgcaaggcgttcgaggagtgccaggaaaaggccaaggagaaccacgagcgcttcggggtcgagtatgaggtgctggacgccgaggcgctctacgccaaggagccgcatctgggcaaggggctgatcggggcgatccactggacgcagccctggatggtctcggacccgggcggcctggtgcaggcctacgcccgcagcttcgaggcgcagggcggccgggtgaagcaggccagcgtcgaggacgtgctccaggtagaaggcggctggcgggtcgagaccagcgaggggcccctggaggccgatgaggtggtggtggccctgggcccctgggccggcgacatgctggagaggctgggcatgaaggtgccgctgttcgtcaagcgcggctaccacatgcactactcctcggaggagggagccaagctcaaccactgggtgatggacgccgagaaggggttcctgctcgagccgatgcgggcggggattcgcctgaccaccggcgccgagctagccgacctggactcgcccccccagtacaagcagctggccgccgccgagaaggtggcacgcaagctgttcccgctgggtaagcgccgcgacagccagccctggaagggggcgcgcccctgcatgccggacatgaagccggtgatcggtcccgcccccgacagggcggggctgtggctcgccttcggccacggccatcagggctttaccctgggcccggccaccggcgagctgctcgcccagatgatggatggcgaagaccccgcggtggacatggccccgttccgcctcgaccgcttctga

SEQ ID NO: 762 - protein, 413 aa, Unknown
  Obtained from environmental sample
  DOMAIN (4)...(395): FAD dependent oxidoreductase
  SITE (97)...(100): N-glycosylation site. Prosite id = PS00001
MARNILVLGAGMVGVSVAWHLVRRGHDVTLVDRREPGLETSFGNAGIIQREAVRPYAFPRDIATLLRVVPNRQVDIRYRPTGMMSAAGPLLNYWLNSSGKRYERIVGEWASLIMRCQDAHAPMIEAAGAEALVRQGGWLELYRTRKAFEECQEKAKENHERFGVEYEVLDAEALYAKEPHLGKGLIGAIHWTQPWMVSDPGGLVQAYARSFEAQGGRVKQASVEDVLQVEGGWRVETSEGPLEADEVVVALGPWAGDMLERLGMKVPLFVKRGYHMHYSSEEGAKLNHWVMDAEKGFLLEPMRAGIRLTTGAELADLDSPPQYKQLAAAEKVARKLFPLGKRRDSQPWKGARPCMPDMKPVIGPAPDRAGLWLAFGHGHQGFTLGPATGELLAQMMDGEDPAVDMAPFRLDRF

SEQ ID NO: 763 - DNA, 1251 bp, Unknown
  Obtained from environmental sample
atgcacaccattgtcatcggcgccggcgtcgtcggcgccagcacggcgctgagcctggccgaacgcggcattcaggtcaccgtcctggatcgtcacgctgaggctgccgctgaaaccagccatgccaacggtggcggtatcactccgggccacgccgagccctggaacgccccgggcatcgtcaaacgtttgctgacccgttctggtgccggcgagccttttcgcattcatgcccatgccctgccagggctgatcggctggggactcggctttctgtggcagtcaaaggcatcgcgctactacctcaatgccaggaacaacacgcggctggcggtgtattccggccagtgcctgaaacgcctgcgcgagcgccatgcgctcagctaccaccagtacaccgacggctctctggagctctacttcagccaatccgaactggaccatgcgctcgatctgcgccgcaagatcggtgatccgggcgtcgagatccgggttatcagcgtcgacgaagtgcttgccatggagccggcgctcgaaccggttgccgggcggatggtcggtgccatgctgctgccgctgcacgaatccggcgatgcctgcgttttttcagccgagatgctgcgctgtgccaagcagctaggggccaacatccggctgggtgccaatgtcgatcgcatcgaacagcgccagggccgggtggtcggtgttcgccttcatgaccagcaattgctggaagccgatgcggtcgtcgttgccgctggctgcagctcgcctgcgctggtcaaaccgctgggcttgcgtctgccgatctatccggtcaagggctattcggccacgctggcgctcgaacaggccgatctggcaccgaccgttccgctactggacctggaacatcgcatcgtcactgcccgctttggaaaccgcctgcgcatggccggcctggccgactttgacggccaaaatcgcgatatacgacccgaccgactggaactgctgctggcatctgcctgcgccctgctaccgcgcctggccgatgaaatccggtccggccgcgccgaagcctggaccggcctgcgcccgatgacgcccaagggcccgcccttgatcggacccacccgcattccgcgtttgttcctgaacacaggccacggctccatgggctggacccaagcggccggctctgccgagctgctggccgatctggtggcagagaaaaccccggcaattgatatggcgccctatcgcccctga

SEQ ID NO: 764 - protein, 416 aa, Unknown
  Obtained from environmental sample
  SIGNAL (1)...(20)
  DOMAIN (2)...(401): FAD dependent oxidoreductase
  SITE (107)...(110): N-glycosylation site. Prosite id = PS00001
MHTIVIGAGVVGASTALSLAERGIQVTVLDRHAEAAAETSHANGGGITPGHAEPWNAPGIVKRLLTRSGAGEPFRIHAHALPGLIGWGLGFLWQSKASRYYLNARNNTRLAVYSGQCLKRLRERHALSYHQYTDGSLELYFSQSELDHALDLRRKIGDPGVEIRVISVDEVLAMEPALEPVAGRMVGAMLLPLHESGDACVFSAEMLRCAKQLGANIRLGANVDRIEQRQGRVVGVRLHDQQLLEADAVVVAAGCSSPALVKPLGLRLPIYPVKGYSATLALEQADLAPTVPLLDLEHRIVTARFGNRLRMAGLADFDGQNRDIRPDRLELLLASACALLPRLADEIRSGRAEAWTGLRPMTPKGPPLIGPTRIPRLFLNTGHGSMGWTQAAGSAELLADLVAEKTPAIDMAPYRP

SEQ ID NO: 765 - DNA, 1182 bp, Unknown
  Obtained from environmental sample
cggcacgaggccatagccgggccgggccaggtgttgctcagcctggaacgcctgtccggcctgcgccggcttgaccgggccgatgccagtgtcgtggtcgaggccggctgtaccctggccgccttgcgccaggcagccgctgcggccggcctggtctatccggtcagcctggcctcggagggtacggccacgatcggcggcaccattgcgaccaacgccggcggcaatctgaccattcgctacggcaatacccgcgaccaggtgctgggcctggaagtggtgctggccgatggccggatctggtccgatctcgagccgctgcgcaaggacaacagcggctatgagatcaagcaatggtttatcggcagcgagggcacgttgggcatcatcaccgccgccgccttgcgtctggcaccggcgccgcgccagagcgtgaccgccatgctgagctgtgccgacctggtcagcggcatggccctgctcgaacagctgcgcgccggcctgggcgaatgcctgtcggcctgcgagttcatgccgcgcctggcgctggagttcgtgcttgccgaccaggccggacagcgcgacccgttcaccggcctgcatccctggtacgtgcttgtccaggccgattcggccctgccggggaccggcctggaaacagcggcgctggaggttttcgagcaggcccggaacaagcgcctgtgcaccgaggtggtcctggccagcagccaggcccaggccaatgccctgtggggcttgcgcgagggcatttcggcggcccagaaacacggcggggtcagcatcaagcacgacatttcggtgcccgtggcccgaattccgcgctttgtcgaagaaaccctggcggcactggagcaggccgtgcccgggattcggccatgcgtattcggccatctcggcgacggcaatctccacttcaacctgagccagcccgagtccgtcgacggcgctgctttccgcgccctggagccgatctgcaatcgcatcgtcttcgaccaggtcagacgctaccgcggctcgattgccgccgaacacggcatcggccagctgcgccgcgacgaactggccgacacccggcctctgaaagtcgaactgatgcgcagggtcaagcaggcactggatcccgatgggctgttgaacccgggcaaggtgctgcggccatag

SEQ ID NO: 766 - protein, 393 aa, Unknown
  Obtained from environmental sample
  DOMAIN (2)...(104): FAD binding domain
  DOMAIN (140)...(390): FAD linked oxidases, C-terminal domain
  SITE (77)...(80): N-glycosylation site. Prosite id = PS00001
  SITE (317)...(320): N-glycosylation site. Prosite id = PS00001
RHEAIAGPGQVLLSLERLSGLRRLDRADASVVVEAGCTLAALRQAAAAAGLVYPVSLASEGTATIGGTIATNAGGNLTIRYGNTRDQVLGLEVVLADGRIWSDLEPLRKDNSGYEIKQWFIGSEGTLGIITAAALRLAPAPRQSVTAMLSCADLVSGMALLEQLRAGLGECLSACEFMPRLALEFVLADQAGQRDPFTGLHPWYVLVQADSALPGTGLETAALEVFEQARNKRLCTEVVLASSQAQANALWGLREGISAAQKHGGVSIKHDISVPVARIPRFVEETLAALEQAVPGIRPCVFGHLGDGNLHFNLSQPESVDGAAFRALEPICNRIVFDQVRRYRGSIAAEHGIGQLRRDELADTRPLKVELMRRVKQALDPDGLLNPGKVLRP

SEQ ID NO: 767 - DNA, 1257 bp, Unknown
  Obtained from environmental sample
atgtcactgcatgtgatcgtgatcggtgccggcgtggttggtgccagcacggtgctgagcctggccgagcgcggcttccaggtcacggtcctggatcgccaccctgaagccgccgccgaaaccagccatgccaacggcggcgggatcacgcctggccatgccgaaccctggaatgcgcccggcattatccggcgcctgctgacccgttccggcaccggcgagccgttccgcattcacgctcacgccttgccaggcctggtcggctggggtctcaattttctgtggcagtcgaaggcgtcgcgctattaccgcaatgccaagaacaatacccgtctggcggtgtattccggccagtgcctgaagcgcctgcgcaagcgccatgagctgagctatcaccagtacaccgacggttcgctggagctatacttcagccgctcggagctggaccatgccctggacctgcggcacaagatcggcgatcccggcgtcgagatccggatcatcgatatcgacgaagtcctggccatggagcctgcgcttgagccggtggccgggcgcatcgccggagccatgctgttgccactgcacgaatccggcgatgcccgcgtcttttcagccgagatgctgcgctgcgccggaaacttgggggccaatacccgcctgggtgccgatgtcgagcacatcgaacagcagcagggccgggtggttggagttcgcctccaaggcggtcagctgcttgaagccgatgcggtggtcgtggccgcaggctgcggctcaccggccctggtcaaccccctgggtctgcgtctgccgatctatccggtcaagggctattcggcgacgctggagctggagcaggccgatctggccccgactattccgctgctggacctggaacaccgcatcgtcacggcccgctttggcaaccgcctgcgcatggccggcctggccgactttgacggtgacaatcgcgacattcgctccgaccggttggaactgctgctggcatctgcctgcgccctgctgccgcgcctggccgacgaaatccgctccggccgagccgaaccctgggccggtttgcgcccgatgaccccaaagggtccgcccctgctcggacccacccgcattcccggcctgttcctcaacaccggccacggctccatgggctggacccaggccgccgggtcggccgaaatcctggccgacctgctcaacgacaaaaccccggcgatcgatctggcccccttccttctatag

SEQ ID NO: 768 - protein, 418 aa, Unknown
  Obtained from environmental sample
  DOMAIN (4)...(403): FAD dependent oxidoreductase
  SITE (109)...(112): N-glycosylation site. Prosite id = PS00001
MSLHVIVIGAGVVGASTVLSLAERGFQVTVLDRHPEAAAETSHANGGGITPGHAEPWNAPGIIRRLLTRSGTGEPFRIHAHALPGLVGWGLNFLWQSKASRYYRNAKNNTRLAVYSGQCLKRLRKRHELSYHQYTDGSLELYFSRSELDHALDLRHKIGDPGVEIRIIDIDEVLAMEPALEPVAGRIAGAMLLPLHESGDARVFSAEMLRCAGNLGANTRLGADVEHIEQQQGRVVGVRLQGGQLLEADAVVVAAGCGSPALVNPLGLRLPIYPVKGYSATLELEQADLAPTIPLLDLEHRIVTARFGNRLRMAGLADFDGDNRDIRSDRLELLLASACALLPRLADEIRSGRAEPWAGLRPMTPKGPPLLGPTRIPGLFLNTGHGSMGWTQAAGSAEILADLLNDKTPAIDLAPFLL

SEQ ID NO: 769 - DNA, 1242 bp, Unknown
  Obtained from environmental sample
atggcccgcaatatcctcgttcttggtgccggcatggtcggcgtatcggtggcctggcatctggtgcgtcgcggccatgacgtcaccctggtggaccgccgcgagccgggcctcgagacctccttcggcaatgccggcatcatccagcgcgaggcggtgcgtccctacgccttcccccgggatatcgccacccttctgcgggtggtgcccaaccgccaggtggacattcgctaccgccccaccggcatgatgagtgcggcgggcccgctgctgaactactggctgaactcgagcggcaagcgctacgagcgcatcgtgggtgagtgggcgtcgctgatcatgcgctgccaggatgcccacgcgccgatgatcgaggccgccggcgccgaggcgctggtgcgccagggcggctggctggagctttatcgcacccgcaaggcgttcgaggagtgccaggaaaaggccaaggagaaccacgagcgcttcggggtcgagtatgaggtgctggacgccgaggcgctctacgccaaggagccgcatctgggcaaggggctgatcggggcgatccactggacgcagccctggatggtctcggacccgggcggcctggtgcaggcttacgcccgcagcttcgaggcgcagggcggccgggtgaagcaggccagcgtcgaggatgtgctccaggtagagggcggctggcgggtcgagaccagcgaggggcccctggaggccgatgaggtggtggtggccctgggcccctgggccggcgacatgctggagaggctgggcatgaaggtaccgctgttcgtcaagcgcggctaccacatgcactactcctcggaggaaggggccaagctcaaccactgggtgatggacgccgagaaggggttcctgctcgagccgatgcgggcggggattcgcctgaccaccggcgccgagctggccgacctggactcgccgccccagtacaagcagctggccgccgccgagaaggtggcacgcaagctgttcccgctgggcaagcgccgcgacagccagccctggaagggggcgcgcccctgcatgccggacatgaagccggtgatcggtcccgcccccgacaaggcggggctgtggctcgccttcggccacggccatcagggatttaccctgggcccggccaccggcgagctgctcgcccagatgatggatggcgaagaccccgcggtggacatggccccgttccgcctcgaccgcttctga

SEQ ID NO: 770 - protein, 413 aa, Unknown
  Obtained from environmental sample
  DOMAIN (4)...(395): FAD dependent oxidoreductase
  SITE (97)...(100): N-glycosylation site. Prosite id = PS00001
MARNILVLGAGMVGVSVAWHLVRRGHDVTLVDRREPGLETSFGNAGIIQREAVRPYAFPRDIATLLRVVPNRQVDIRYRPTGMMSAAGPLLNYWLNSSGKRYERIVGEWASLIMRCQDAHAPMIEAAGAEALVRQGGWLELYRTRKAFEECQEKAKENHERFGVEYEVLDAEALYAKEPHLGKGLIGAIHWTQPWMVSDPGGLVQAYARSFEAQGGRVKQASVEDVLQVEGGWRVETSEGPLEADEVVVALGPWAGDMLERLGMKVPLFVKRGYHMHYSSEEGAKLNHWVMDAEKGFLLEPMRAGIRLTTGAELADLDSPPQYKQLAAAEKVARKLFPLGKRRDSQPWKGARPCMPDMKPVIGPAPDKAGLWLAFGHGHQGFTLGPATGELLAQMMDGEDPAVDMAPFRLDRF

SEQ ID NO: 771 - DNA, 1245 bp, Unknown
  Obtained from environmental sample
atgggtgacatcgacgacgtaatcgtgctcggcgccggcatcgtgggcacgacgaccgcgctgaacctgcagcggcgcggccggcaggtaacgctggtcgaccggcgcgggccgggcgaggagacgtcctacggcaatgccggcgtgatcgagggcggtacctatgtgccaattccctttccccgcgatccgctggccgtcctgcgctacgccaccaaccggcattcggcgctgcatttccactggcgcttcctgccgcgcatcgcgccctggctggtcgccctgttccgaaattcctccgaggcgcagcttgtgcagaacggctcggcggtaatgacgctgaccgcccatgccatcgccgagcatcgggcactcttggcgcaggccggtgccgaggggctgatgcgcgatacgggatggctcaggctctatcgcaccgaggccgagttccaggccgacaaactggaaatgcggatcgccgacgagggcggctttccctacacggtgctcaacgctgacgaagcgcgcgaggtcgagccccatttggctccggtgtttgcaagggcggtgcattggggcaccgtctgctcggtgtccgatcccggaggggtgaccagggcggcggccgatctattcacaagggctggaggccgcctcgagcgggccgaggcacggcgcctcacgccggccgatagaggatggcgggttgagaccggggagggagcgctggctgcccgcgaggtcgtggtcgccctcggtccctggtcgatggaattgctgcgcccgctcggcctgcggctgccctttgcgatcaagcgcggctaccacatgcactatcggccccaagggaacgcggcgctgtcgcggccggtggtcgacgggagctatggctacgcgctggcgccgatgaacgccggtatccggctgaccacaggcatcgagttcgccccgctcgacgccgccccgactccggtccaggtcgcccgcgccgaaccgcatgcccgagagctgttcccgctcggcgaggcggtggagcccgaaccctggatgggtcggcggccgtgctttcccgattccaagccggtgaccggcgcggcccccgggcatcgggggttatggcttaatttcggccatgcccatctcggcttcaccctgggtccggtcagcggccggctgctcgccgagatgatgacaggcgaagacccggttgccgatcctgcgcctttcgcgcccacgcgcttttga

SEQ ID NO: 772 - protein, 414 aa, Unknown
  Obtained from environmental sample
  DOMAIN (6)...(396): FAD dependent oxidoreductase
  SITE (99)...(102): N-glycosylation site. Prosite id = PS00001
  SITE (108)...(111): N-glycosylation site. Prosite id = PS00001
MGDIDDVIVLGAGIVGTTTALNLQRRGRQVTLVDRRGPGEETSYGNAGVIEGGTYVPIPFPRDPLAVLRYATNRHSALHFHWRFLPRIAPWLVALFRNSSEAQLVQNGSAVMTLTAHAIAEHRALLAQAGAEGLMRDTGWLRLYRTEAEFQADKLEMRIADEGGFPYTVLNADEAREVEPHLAPVFARAVHWGTVCSVSDPGGVTRAAADLFTRAGGRLERAEARRLTPADRGWRVETGEGALAAREVVVALGPWSMELLRPLGLRLPFAIKRGYHMHYRPQGNAALSRPVVDGSYGYALAPMNAGIRLTTGIEFAPLDAAPTPVQVARAEPHARELFPLGEAVEPEPWMGRRPCFPDSKPVTGAAPGHRGLWLNFGHAHLGFTLGPVSGRLLAEMMTGEDPVADPAPFAPTRF

SEQ ID NO: 773 - DNA, 1242 bp, Unknown
  Obtained from environmental sample
atgtcccgcaatatcatcgttctcggcgccgggatggtcggcgtctcggtggcctggcacctggcgcgccgcggccacgacgtaaccctggtggatcgtcgcgccccgggcctcgagacctctttcggcaatgccggcatcatccagcgcgaggcggtgcgcccctacgccttcccccgggatctcggcaccctgctgcgcgtgctgcccaaccgcgaggtggacatccgctatcgtccgaccggcatggtcggtgcggcggggccgctgctgcagtactggatcaactccggcggggcgcgctacgagcgcatcgttaacgagtgggcctccctgatcgtgcgctgccaggacgcccacgcgccgatgatcgaggccgccggcgccgaggcgctggtgcggaaggggggctggctggagctctaccggacccgcaaggcgctggaagaacggctgcaggaggcccgcgaggatcacgagcgtttcggcgtggagtatgaggcgctggatgcaaaggccctctatgccaaggagccgcacctggccgaagggctggtcggtgccatccactggacccagccgtggatggtggcggaccctggcggtctggtgcaggcctatgcggcgaacttcgaggcgctgggtggccatgtgatgcaggccagcgtcgaggaggtgcatcaggtgggcaccggctggcgcgtcatcaccagcgagggcgccattgaggcgcagcaggtcgtagtggccatgggcccctggagcggcgagctgctgtcacagctgggcctcgaagcgccgctgttcgttaagcgtggctatcacatgcactactcggcggagggagaggccagtctcaaccactgggtgatggatgccgagcggggctttctgctcgagccgatgcgggccggcattcgcctgaccaccggtgcggagctggccgacctggacgcgccgccccagtacaagcagctggcggcggcggagaaggcggcgcgcaagctgttccccctgggcaagcggcgcgatgcccagccgtggaagggtgcgcgtccctgcacgccggacatgaagccggtgatcggcgccgcgcccgggaaggaggacctgtggctggccttcggccacggccatcagggcttcaccctggggcctgccaccggcgagctgctggcccagatgatggatggcgagactccggcggtcgacatgacgccgttccgcttcgagcgtttctga

SEQ ID NO: 774 - protein, 413 aa, Unknown
  Obtained from environmental sample
  DOMAIN (4)...(395): FAD dependent oxidoreductase
MSRNIIVLGAGMVGVSVAWHLARRGHDVTLVDRRAPGLETSFGNAGIIQREAVRPYAFPRDLGTLLRVLPNREVDIRYRPTGMVGAAGPLLQYWINSGGARYERIVNEWASLIVRCQDAHAPMIEAAGAEALVRKGGWLELYRTRKALEERLQEAREDHERFGVEYEALDAKALYAKEPHLAEGLVGAIHWTQPWMVADPGGLVQAYAANFEALGGHVMQASVEEVHQVGTGWRVITSEGAIEAQQVVVAMGPWSGELLSQLGLEAPLFVKRGYHMHYSAEGEASLNHWVMDAERGFLLEPMRAGIRLTTGAELADLDAPPQYKQLAAAEKAARKLFPLGKRRDAQPWKGARPCTPDMKPVIGAAPGKEDLWLAFGHGHQGFTLGPATGELLAQMMDGETPAVDMTPFRFERF

SEQ ID NO: 775 - DNA, 1272 bp, Unknown
  Obtained from environmental sample
atgcgtgtcttggtcataggtgctggtctggcaggcctcacggcggcgtggtatctgcaagagcaaggctgccagatcactatccttgatcgtcgggaggggcccggactcgggacaagttttgcgaatggcgcgcttctgcacccgagcgcatgcgagccatggaacgctccgggcatcctgccaactatcatgaaatcgatcggctcgggtgattcaccgtttttatttcgcgcgaatgcgctgccgagccttctgggatggggcccccgttttctgctcggtagtcgccgcaagcaattcctgaagaccacccagtgcaatacgtctctcgcgctgtacggtatgcgacttcagcgtgagatgcgtgctggcgccgaaatacgtgacggggcctacacgcgtggttcgctgcatttgttccgcagtagcgattcgctggtacgtgcagagcagtgggcccagttgctcaagcagttcggtgtcatttctagagcactcaacgtcgagcagactctggaactcgagcctgcgctgcgcccattgcaggatggcctcgcaggaagcaggcactttgcccaagatgtcagcgccgacgcgcatcgattctgcttcgaactgtcgcgaatcctgcgcgatcgtggcgttcagcttttgtttggttccgctgtgaaacgcgtccttcgaaagggccgacacgtgcatggcattgaaaccgatggtggtcgcgtgctgcacgctgatcgctacctgctcgcggcgggcagcgacagcccgctcatatcccgcaccgtcggcgtccgattaccgattgttccagttaaggggtattcgatcacggtggacggcggaggcgcactcgactttccccaactgccgctcgttgatcgtgatcgacattttgccgttgttcctctcgagaatggccacctgcgcgtcgtcggcttggccgagtttgccggacatgacattcgagttgacgagagaagaatagcgacgctccgtaatcttgtgaccggaattctgccggcgtgtcggccgatgattagcgacggtctagcacaaacgtgggctggccttcgccccatgtgcgcggatggcgcgccgattatcggtcgctcccctgtggagaatctcttcctgaataccggccatggacaacttgggtggacgctcgctgcgggctcggggaagctggtggcggacctgattctcgatcgcgcgcctgaaatcgatccagcgccttttacaccggaccggttcatcttttag

SEQ ID NO: 776 - protein, 423 aa, Unknown
  Obtained from environmental sample
  DOMAIN (2)...(403): FAD dependent oxidoreductase
  SITE (109)...(112): N-glycosylation site. Prosite id = PS00001
MRVLVIGAGLAGLTAAWYLQEQGCQITILDRREGPGLGTSFANGALLHPSACEPWNAPGILPTIMKSIGSGDSPFLFRANALPSLLGWGPRFLLGSRRKQFLKTTQCNTSLALYGMRLQREMRAGAEIRDGAYTRGSLHLFRSSDSLVRAEQWAQLLKQFGVISRALNVEQTLELEPALRPLQDGLAGSRHFAQDVSADAHRFCFELSRILRDRGVQLLFGSAVKRVLRKGRHVHGIETDGGRVLHADRYLLAAGSDSPLISRTVGVRLPIVPVKGYSITVDGGGALDFPQLPLVDRDRHFAVVPLENGHLRVVGLAEFAGHDIRVDERRIATLRNLVTGILPACRPMISDGLAQTWAGLRPMCADGAPIIGRSPVENLFLNTGHGQLGWTLAAGSGKLVADLILDRAPEIDPAPFTPDRFIF

SEQ ID NO: 777 - DNA, 1233 bp, Unknown
  Obtained from environmental sample
atgcaaagcgcaatggttctcggcggcggcatgatcggcgtgagcgcggcgctgcacctccagcagcgcggctgggccgtcacgctcatcgaccgcagggagccgggccgcgagaccagctacggcaacgccggcatgatccaggccgaagcggtgcgtccctatccgatgccgcgcgaccttgcgacgctcctgaagatcgcgaccggccgcaccaacgacgtgcgctacagcctgtcgtcgcttcacctccatatcgagcccctgctccgctactggtggcattcggcgccgaaacggcatcgcgaggcgatcgacgcgtgggcgcgactaatcggctacgcgacgtcggagcacgacattctcattcgcgaggcccatgccgacaatctgatccgccgcgcgggttatcgtgcgctttaccgcgacgccgcggacctcgatctctcgatcaaggccgcggaggacgaccagcgcgaattcggggtgaagtttcgcgtgctctccggcagcgagcttgccagggccgagccgatcctgcgcgacgatcttcccggcgcgatacattggctcgacacctggaccgtgtccgatcccggcgcgcttgtcaccgcctatgccgagctgttcgagcgccgcggcggccgcatcgtgctcggcgatgcgcaatcgctgcggcagaccgcgaccggctggtcggtcgacacggaccagggccgcctcgacgccgcccacgccgtcgtgacgctcgggccgtggtcgcccgatctgctgcagaagttcggctatcgcattccgctggtgcgcaagcgcggctaccacatgcactacagcggcggcgtctcgctcgacctgccgctcgtcgacaagggcagcggctacgccatgggcccgatggccaagggcatccgcatcaccaccggtgccgaattgaccggcatggacgcgctcgccacgcccgtgcagctggccagcgcggaagcctccgcgcgcgagctgatcgacctcggcaaacgcgtcgagccggatccgtggttcggcacccgcccctgcacgcccgacatgctgccggtgctcgggcaagctccgcgtcatcccggcctctggatgaatttcggccacggccaccagggcttcacgctgggacccgcgaccggacgtctgcttgcagaaatcatgagcggcgagacgccggcgattgatccggccccctatcggcccgagcggttctag

SEQ ID NO: 778 - protein, 410 aa, Unknown
  Obtained from environmental sample
  DOMAIN (3)...(392): FAD dependent oxidoreductase
MQSAMVLGGGMIGVSAALHLQQRGWAVTLIDRREPGRETSYGNAGMIQAEAVRPYPMPRDLATLLKIATGRTNDVRYSLSSLHLHIEPLLRYWWHSAPKRHREAIDAWARLIGYATSEHDILIREAHADNLIRRAGYRALYRDAADLDLSIKAAEDDQREFGVKFRVLSGSELARAEPILRDDLPGAIHWLDTWTVSDPGALVTAYAELFERRGGRIVLGDAQSLRQTATGWSVDTDQGRLDAAHAVVTLGPWSPDLLQKFGYRIPLVRKRGYHMHYSGGVSLDLPLVDKGSGYAMGPMAKGIRITTGAELTGMDALATPVQLASAEASARELIDLGKRVEPDPWFGTRPCTPDMLPVLGQAPRHPGLWMNFGHGHQGFTLGPATGRLLAEIMSGETPAIDPAPYRPERF

SEQ ID NO: 779 - DNA, 1233 bp, Unknown
  Obtained from environmental sample
atgaaattcgataccgtggtgctcggcgccggcattgtcggggtgtgcgtcgccgtgcatctgcagaaacgcgggcgcgcggttgcgctgatcgaccgtaagcagccgggcaacgagacctcgttcggtaacgccgggctgatccagcgcgaaggcgtctatccgtacgcgtttccgcgcgggctcggcaccctgctgcgctatgcgcgcaaccagtcgcccgatgtgcgctaccacgccgacgcgatgctccaggctgcgccgtttctttggcgctattggcgcaactcgcatccggcaaagcacgcggaaatcgcgaagtcgtacgcgacgctgatcgagtattgcgtcagcgaacatcgcgcgcttgccgcggacgccggtgcgagcgcgctgctgcggccgatcggctggatcaaggtgtttcgccacgccgccgcgcgcgacgctgaagtcaccctcgccgagcagtggcatcgcgaatacggcgtcgagttcgaaacgctcgacgcgccgcgcctgcaacaactcgaacccgatctcgacaagcgtctgcaaggcgggctgcgctatccgcaatccgattcggtcagcgatccgaacgcgctcgtcaccgcctacgcgcggtacttcgaagcgctgggcggacgcttcttcatcggcgatgccgatacgttgcgcgaaggctggcaggtcgaaacgcgggacggaccgatctcggccgcgtcggcggtgatcgcgctcgggccgtggtcggaccgcgcaagcacgcggctcgggtaccggctgccgctcgcggccaagcgtggctatcacatgcactacgccgcgcgtcggaccgcgcggctcaatcatccgattctcgacgtcgaacacggctatgtgctcgcgccgatggcgcgcggcatccggttgaccacgggtgccgaaatcgcgcgacccgaggccgccaagacgccggtgcaactcgacgcggtcgaaccgatcgcacgcacgctgtttccgctcggcgaacgcctggacgccgaaccgtggatgggacgccgcccgtgcacgccggacatgatgccgatcatcggacccgcgacgaaacatcagggactgtggttcgcgttcggccatgcgcaccatggtttgacgctcggaccggtgacggggcggctgatcgccgagatgatgaccggcgaagagacgctggtcgacccgcggccgtttcgggtcgagcggttttag

SEQ ID NO: 780 - protein, 410 aa, Unknown
  Obtained from environmental sample
  DOMAIN (4)...(392): FAD dependent oxidoreductase
  SITE (38)...(41): N-glycosylation site. Prosite id = PS00001
MKFDTVVLGAGIVGVCVAVHLQKRGRAVALIDRKQPGNETSFGNAGLIQREGVYPYAFPRGLGTLLRYARNQSPDVRYHADAMLQAAPFLWRYWRNSHPAKHAEIAKSYATLIEYCVSEHRALAADAGASALLRPIGWIKVFRHAAARDAEVTLAEQWHREYGVEFETLDAPRLQQLEPDLDKRLQGGLRYPQSDSVSDPNALVTAYARYFEALGGRFFIGDADTLREGWQVETRDGPISAASAVIALGPWSDRASTRLGYRLPLAAKRGYHMHYAARRTARLNHPILDVEHGYVLAPMARGIRLTTGAEIARPEAAKTPVQLDAVEPIARTLFPLGERLDAEPWMGRRPCTPDMMPIIGPATKHQGLWFAFGHAHHGLTLGPVTGRLIAEMMTGEETLVDPRPFRVERF

SEQ ID NO: 781 - DNA, 1272 bp, Unknown
  Obtained from environmental sample
gtgaaggcagggctggaagggtggcaggtgcgcacagttgacgtcatcgtgcttggcgccggcatggtcggaacctcgaccgccctgcagttgcagcgacgggggcttgatgttgcccttgtcgaccgccgccagcccggcgaagagacgtcccatggtaatgccgggatcatagagcgcaacggattcctgccgcccggttttcccggagatgcgaaattcttgctcaacatcgcgctggggcgctggcccggcgccaattacagcctttctgccgtgctgcgtctgctgccctggctgatggcgttccgccgccacggcagccgcacgggtgtgcagcgccttgcccatgcgatgaatgcgctggaggcctatgccatcggcgagcacagggtgctggcggaagccgcggaggcgctgaaatattaccggcagacgggcaccatttacgtctaccgcacggaggcagggttcgaggcgacggcggccgagcgccattatgcccggatcttcggcgtcgattatcacgagctggacgaactcgatctcaacgaactggagccctatctcaccgccgaggggtgccgcggcatcttctggcccgagagcgaatcggtgtccaatcccggcgccgtcaccaaggcctttgcccggtcgctggcggagaagggcggcgagatcctgaccggggatgcaaggcgcttgacgcgctcgcacgggggctgggccattgccacggacaaggggccggtgcgcgggcgcgccgttgccctgtgtctggggccatggtccatggatatcctgaaaggcttcggctaccgcttcccgcttgccgttaagcgcggttaccaccagcactacaaggcgagggcaggggcggggctgtcgcggcccgtggtggatgcggaaatgggctatgtgctggcgccgatggaaaagggcatccgcctgacgacgggcattgaactggccgaacgggatgcggcgccgacgccggtgcaggtggagcgggccttccgcaaggcccgcgagatctttccgctgacggttcctgccgaacccggtgcctggatgggctcacgcccctgtttcccggacagcttgccggtgctgggcgctgcccccggcgaaagcggcctgtggctcaacttcggccatggccattgcggttttacgctggggccggtcaccggccatattctggccgatctcatcaccggcgtgccgccggtcatcgaccctgcgccgctgtcccccctccggtttctgtaa

SEQ ID NO: 782 - protein, 423 aa, Unknown
  Obtained from environmental sample
  DOMAIN (14)...(404): FAD dependent oxidoreductase
  SITE (88)...(91): N-glycosylation site. Prosite id = PS00001
MKAGLEGWQVRTVDVIVLGAGMVGTSTALQLQRRGLDVALVDRRQPGEETSHGNAGIIERNGFLPPGFPGDAKFLLNIALGRWPGANYSLSAVLRLLPWLMAFRRHGSRTGVQRLAHAMNALEAYAIGEHRVLAEAAEALKYYRQTGTIYVYRTEAGFEATAAERHYARIFGVDYHELDELDLNELEPYLTAEGCRGIFWPESESVSNPGAVTKAFARSLAEKGGEILTGDARRLTRSHGGWAIATDKGPVRGRAVALCLGPWSMDILKGFGYRFPLAVKRGYHQHYKARAGAGLSRPVVDAEMGYVLAPMEKGIRLTTGIELAERDAAPTPVQVERAFRKAREIFPLTVPAEPGAWMGSRPCFPDSLPVLGAAPGESGLWLNFGHGHCGFTLGPVTGHILADLITGVPPVIDPAPLSPLRFL

SEQ ID NO: 783 - DNA, 1137 bp, Unknown
  Obtained from environmental sample
tcggcacgaggcaggctggatccagtggatgccagcatggtggtcgaggctggctgcacgctggccggggtgcgggcagccgcagcggcggcgggcctgttttatccggtcagcctggcctccgaaggcacggctacgataggcggtactctggccaccaacgccggcggcaatctcaccattcgctacggcaatacccgcgagcaggtgctgggcctggaggtggtgctggccgacgggcggatatggtccgatctcgatcccttgcgcaaggacaacagcggttatgacttaaagcagctgttcattggcagcgaaggcaccctgggtatcatcaccgccgccacgctgaagctggcgcccgcaccgcgtcagagcctgacggccatgctggcttgccctgatttgcccacgaccatggtcctgttgaagcacctgcgggcgggtctgggtgagtgtttatcagcctgcgagttcatgccgcgccttgcgctggggtttgtgctggccgatcagccaatcctgcgcgatccttgcgaacgcccgcatccctggtatgtgctggtccaggccgattccagcctgccgggtgacagcctggaggtggccgcgcacagcgttttgaaccaggcgttggagaacaatctatgccacgaggttgtcgttgccggctccaacgctcaagccgatgcgctgtgggcgctgcgcgagggcatttcggcggcgcagacgcatggcggggtcagtctcaagcatgacatctccgtgcccgtggcccgcattcccgaattcgtcgtcgaaaccgtgtcgttgctggaacaggccgtgccgggtatccgcccctgcattttcggccatctcggcgacggcaacctgcatttcaacctgagtcagccggaggacatggctgccgaggccttccgcgctctggagccggcttgcaaccgcattgtttttgatcaggtcaggcgctatcgcggctccattgcagccgaacacggcatcggccaactgcgccgcgacgaactggctgcgggtcagccgctgaaagtggcgttgatgggcaagatcaagcaggcccttgatcccaacggcttgttcaaccccggaaagcttgtgcggccttgccaacggtag

SEQ ID NO: 784 - protein, 378 aa, Unknown
  Obtained from environmental sample
  DOMAIN (122)...(372): FAD linked oxidases, C-terminal domain
  SITE (58)...(61): N-glycosylation site. Prosite id = PS00001
  SITE (65)...(68): N-glycosylation site. Prosite id = PS00001
  SITE (299)...(302): N-glycosylation site. Prosite id = PS00001
SARGRLDPVDASMVVEAGCTLAGVRAAAAAAGLFYPVSLASEGTATIGGTLATNAGGNLTIRYGNTREQVLGLEVVLADGRIWSDLDPLRKDNSGYDLKQLFIGSEGTLGIITAATLKLAPAPRQSLTAMLACPDLPTTMVLLKHLRAGLGECLSACEFMPRLALGFVLADQPILRDPCERPHPWYVLVQADSSLPGDSLEVAAHSVLNQALENNLCHEVVVAGSNAQADALWALREGISAAQTHGGVSLKHDISVPVARIPEFVVETVSLLEQAVPGIRPCIFGHLGDGNLHFNLSQPEDMAAEAFRALEPACNRIVFDQVRRYRGSIAAEHGIGQLRRDELAAGQPLKVALMGKIKQALDPNGLFNPGKLVRPCQR

SEQ ID NO: 785 - DNA, 1251 bp, Unknown
  Obtained from environmental sample
atgcacaccattgtcatcggtgccggggtggtcggcaccagcacagcgctgagcctggccgagcgagggctgtctgtcaccgttgtggaccgccataccgaggccgctgccgaaaccagccatgccaacggtggtggcatcacccccggccatgccgaaccctggaacgcgcccggcatcatccggcgcctgctgacccgttccggtgccggcgagccgtttcgcattcatgcccatgccttgccaggcctgatcggctgggggtttgattttttgtggcagtcgaaggcgtcgcgctattaccgcaatgcgaaagccaacacccggctggcggtgtattccggccagtgcctgaaacgcctgcgcgagcgtcatcagctgagctatcaccagtacacggacggctcgctggagctgtatttcagtcgctcggagctggatcatgccctggatctgcggcgcaagatcaacgatcccggcgttcagatccgggtcatcaatgtcgacgaagtgctggccatggagccggcgctggagccggtagccgggcgcatggccggcgcgatgctgctgccgcttcacgaatccggcgatgcctgcgtcttttcagccgagatgctgcgttgcgctgaatccctgggcgcgaacatccggcttggggccaatgttcagcgcatcgaacagcaacacggccgggtgataggcgttcgcttggcagacgggcatctactcgaagccgatgccgtcatcgtggctgcgggctgtggctcgccggccctggtcaaaccgctgggcttgcgcctgccgatctatccggtcaagggctactcggccacgttggagctcgagcgggccaaactcgcaccgatcatcccgctgctggacctggaacatcgcatcgtcaccgcccgctttggtaatcgcttgcggatggccggcctggccgactttgacggccacaatcgcgatgttcggtcagaccggctggaactactgctggagtccgcctgtgccctgctgccgcgtctggccgacgaaatccgctccggccgtgccgaagcctggaccggcctgcgcccgatgacgcccaagggccccccactgatcggacccacccgacttccggggttgttcctcaataccggccacggctccatgggctggacccaggcggccggatcggccgagctgatggctgatttgttgaccggacaggccccagcgatcgagcttgccccctactgttgctga

SEQ ID NO: 786 - protein, 416 aa, Unknown
  Obtained from environmental sample
  SIGNAL (1)...(20)
  DOMAIN (2)...(401): FAD dependent oxidoreductase
MHTIVIGAGVVGTSTALSLAERGLSVTVVDRHTEAAAETSHANGGGITPGHAEPWNAPGIIRRLLTRSGAGEPFRIHAHALPGLIGWGFDFLWQSKASRYYRNAKANTRLAVYSGQCLKRLRERHQLSYHQYTDGSLELYFSRSELDHALDLRRKINDPGVQIRVINVDEVLAMEPALEPVAGRMAGAMLLPLHESGDACVFSAEMLRCAESLGANIRLGANVQRIEQQHGRVIGVRLADGHLLEADAVIVAAGCGSPALVKPLGLRLPIYPVKGYSATLELERAKLAPIIPLLDLEHRIVTARFGNRLRMAGLADFDGHNRDVRSDRLELLLESACALLPRLADEIRSGRAEAWTGLRPMTPKGPPLIGPTRLPGLFLNTGHGSMGWTQAAGSAELMADLLTGQAPAIELAPYCC

SEQ ID NO: 787 - DNA, 1251 bp, Unknown
  Obtained from environmental sample
atgcatgccattgtcatcggtgccggcgtggtcggtgccagcacggcgctgagcttggccgaacgcggctttcaggtcaccgtcctggaccgtcacgctgaagctgccgccgaaaccagccatgccaacggtggcgggatcactccgggccacgccgagccctggaatgccccgggcatcatccggcgcttgttgacgcgctccggtgccggcgaggcgtttcgcattcatgcccacgccctgccggggttgattggctggggtctcggttttctttggcagtcgaaggcaacccggtactacgtcaatgccaagaataacacccggctggcagtgtattccggccaatgcctgaaacgcctgcgcgagcgtcatgagctgagctaccaccagtacacggaaggatcgctggagctgtatttcagccaatcggagctggatcacgcgctggacctgcgtcgcaacatcggtgatcccggcgtcgagatccgggtcattgatgtcgacgaagttctggccatggaacctgcgcttgagccagtggcgagacgcatggtcggagccatgctgctgccgctgcacgaatccggcgatgcccgcgttttttcagcagagatgctgcgctgtgccaagcagctgggggccaatattcgcctgggtgtcgatgtcgagcgcatcgaacagcatcagggccgggtgattggcgttcgcctccaggacggtcagctgctcgaagccgatgcggtggtcgtggctgccggctgcggctcgccggtcctggtcaaaccgctgggtctgcgtctgccgatctatccggtcaagggctattcggcgacgctggagctggagcaggccgatctggcaccgaccattccgctgctggacctggaacaccgcatcgtcactgcccgctttggcagtcgcctgcgcatggccggcctggccgactttgatggccacaatcgcgatatacgacccgaccgactggagctgctgctggaatctgcctgtgccctgctgccccgcctggccgatgaaatccggtccggccgcgccgaagcctggactggcctgcgcccgatgacgcccaagggtccgcccttgatcgggcccacccgcattccgggcttgttcctgaacaccggccacggctccatgggctggacccaggcggccggctcggccgaagtgctggccgatctggcggcaaagaaaaccccggccatcgatatggcgccctatcgcccctga

SEQ ID NO: 788 - protein, 416 aa, Unknown
  Obtained from environmental sample
  DOMAIN (2)...(401): FAD dependent oxidoreductase
  SITE (107)...(110): N-glycosylation site. Prosite id = PS00001
MHAIVIGAGVVGASTALSLAERGFQVTVLDRHAEAAAETSHANGGGITPGHAEPWNAPGIIRRLLTRSGAGEAFRIHAHALPGLIGWGLGFLWQSKATRYYVNAKNNTRLAVYSGQCLKRLRERHELSYHQYTEGSLELYFSQSELDHALDLRRNIGDPGVEIRVIDVDEVLAMEPALEPVARRMVGAMLLPLHESGDARVFSAEMLRCAKQLGANIRLGVDVERIEQHQGRVIGVRLQDGQLLEADAVVVAAGCGSPVLVKPLGLRLPIYPVKGYSATLELEQADLAPTIPLLDLEHRIVTARFGSRLRMAGLADFDGHNRDIRPDRLELLLESACALLPRLADEIRSGRAEAWTGLRPMTPKGPPLIGPTRIPGLFLNTGHGSMGWTQAAGSAEVLADLAAKKTPAIDMAPYRP

SEQ ID NO: 789 - DNA, 1248 bp, Unknown
  Obtained from environmental sample
gtgaaagaggtcgttgttctcggcgctgggatggtcggcacagcaacggctctcgcgctgcaggaacgaggatatgacgtcaagttgctcgaccgcaggtccccggggcgcgagaccagctacgggaacgccggcgttatccagggcgaagcgcacgagccgtatgctatgccacgggacatcagaacgctcgctcgtatcgctctcagaaaagacaacaatgtgaattgggacgcgcgcggactgtggcgtgccgcgccttcgctcctatcgtactggcaccattcggcgcccacgagacatcggaaggtcagcagcgaatacgcacagcttattcggcgtgcgacgcgtgaccacgcgaaatggatggcagcgtccgggtcggagacactgatccgccgcgacggctatcgtgtggctttccgcgacgatgaatcatttgaagctcagctgcgcaatgcggtgcgattgcgcggcctgtacggcgcgaccttcgacagcgaagactccgaggcgctggcggccgccgagccggcactgcgccaacgcctggctggcgcgatacgatggcgagatgcttggacctgcagcgatcctggcgctcttgttcaagcttattcggagctattcgtgagccagggcggtgagttgctcgagcgtgacatccttggactggaggaggattcatacgggtggcggttgcatacggccgtcgggacaatcgacacatcgcaagttgtcgtggcactcggcccctggtcgcccaacctcctggcatcgctaggatacaagatacgcatggtcccgaaacggggttaccacctgacctaccgatatccggcggagggcggtcctcgcctcaacctgccgcttctcgatgcttcgctaggcgccatatacgcgcccatgcgcgccggccttcgtgttgcgacggctgcggatttggcgtcctttcgcgcaggcgtcatgccgaggcaaatgcagcgcgccgagctggctgctcgcgagctgttcgacatcggcccatcgaacgaaacgtcggtatggatgggcgttcgcccttgcatgcccgatatgatgccggttgtcggagccgcaccccatcatcgcgggctctggttcaactttgggcacggtcatcaaggattcacactgggcccgacaaccggagagttactcgccgaagcaatggacctcgaaacagccggatcaattccgccaatcgcggcctcgcggacgtttcgttag

SEQ ID NO: 790 - protein, 415 aa, Unknown
  Obtained from environmental sample
  SIGNAL (1)...(19)
  DOMAIN (3)...(396): FAD dependent oxidoreductase
  SITE (349)...(352): N-glycosylation site. Prosite id = PS00001
MKEVVVLGAGMVGTATALALQERGYDVKLLDRRSPGRETSYGNAGVIQGEAHEPYAMPRDIRTLARIALRKDNNVNWDARGLWRAAPSLLSYWHHSAPTRHRKVSSEYAQLIRRATRDHAKWMAASGSETLIRRDGYRVAFRDDESFEAQLRNAVRLRGLYGATFDSEDSEALAAAEPALRQRLAGAIRWRDAWTCSDPGALVQAYSELFVSQGGELLERDILGLEEDSYGWRLHTAVGTIDTSQVVVALGPWSPNLLASLGYKIRMVPKRGYHLTYRYPAEGGPRLNLPLLDASLGAIYAPMRAGLRVATAADLASFRAGVMPRQMQRAELAARELFDIGPSNETSVWMGVRPCMPDMMPVVGAAPHHRGLWFNFGHGHQGFTLGPTTGELLAEAMDLETAGSIPPIAASRTFR

SEQ ID NO: 791 - DNA, 1044 bp, Unknown
  Obtained from environmental sample
atggatacagtgaaagttgttttgtggggcatcggtgccatgggttcagggatgtatcaccttctgcagaaaaagcaaggtgtccacattgccagtgccatcgggagaaatcccgggaagctgggaagagatctcggagaggctttgggcacggagccctgcggtgttcgtgtttcagaagatgctgaaaaagtcctgaatcaaaacgcgccttcagtggttctccatgccacaggctcctttttgaaggacgtttacgaagaactcgtcctggccatcaggtcgggggctcatgtcatcaccatcgccgaagagatggcggaaccctgggcagcggactctcggctggccgatcaactgaaccaagaggcgaaggaaaggggcgttaccgtcatcgggacgggaatcaatccaggttttgttcttgacgctctcatcatagccatgtcaggggtttcccttcacatcaacaaaattgaagcggaacgcattaacgaccttgctcccttcggctcctccgtgatggcttcccagggcgtgggcgtcacccccgaggcctttgagaggggcgttcaaaacggaaccattgtggggcatattgggtttaaacagtccatcagcctcattgcaagggccttcgactgggagttggaccgcattgtggaggaaaaggaacccatcatctccacaacacggcgggaaacaccttatgtcatcgtggaaccgggcatggtagccggatgccgtcaccatgcctacggttatgtgaaggacttggaagtcatcagcctgaaacacccccaacaggtgcgtcctgaaatggaagaggtggaaacaggcgatttcatcaagcttcacggcgaacccacccttaacatcgccatcaagcccgaaattccaggaggcaaaggaacgacagccaaggcggtcaacatgatccccgttgttttgaaaagcagccctgggttgaaaacactgctggacgttttaacccccatctggtggaacaccctcagaaaaggtgaccacaccattggctcttga

SEQ ID NO: 792 - protein, 347 aa, Unknown
  Obtained from environmental sample
  DOMAIN (4)...(106): Dihydrodipicolinate reductase, N-terminus
  SITE (195)...(198): N-glycosylation site. Prosite id = PS00001
MDTVKVVLWGIGAMGSGMYHLLQKKQGVHIASAIGRNPGKLGRDLGEALGTEPCGVRVSEDAEKVLNQNAPSVVLHATGSFLKDVYEELVLAIRSGAHVITIAEEMAEPWAADSRLADQLNQEAKERGVTVIGTGINPGFVLDALIIAMSGVSLHINKIEAERINDLAPFGSSVMASQGVGVTPEAFERGVQNGTIVGHIGFKQSISLIARAFDWELDRIVEEKEPIISTTRRETPYVIVEPGMVAGCRHHAYGYVKDLEVISLKHPQQVRPEMEEVETGDFIKLHGEPTLNIAIKPEIPGGKGTTAKAVNMIPVVLKSSPGLKTLLDVLTPIWWNTLRKGDHTIGS

SEQ ID NO: 793 - DNA, 1233 bp, Unknown
  Obtained from environmental sample
gtgaaagtcgatgcggtcgtcctgggcgccggcatggtcggcatcccggttgcgttgcacctgcaggcgcgcgggcgctcggtggtgctggtggaccggcgcggcgcggccgaggaaacctcctacggcaacgcgggcctgatccagcgcgagggcgtctatccctacggcttcccgcacgacttcggcgcgctgctgcgctacggcttcaaccggaccatcgacgcgcactaccacccgtcggcgctgctcgacctggcgcctttcctgtggaagtactggcaccactcgcgcccggcgcgccacgccgagatcgcgcgcctgtacgccaggctgatcgagcactgcgtgaccgagcacgacgcgctggcgcaggaagccggcgccacggacctcatcaagcgcaagggctggatgcgcgtcatccgcaccgagcggcagcgcgacaagctgttcgcggaggcggagcagtggcgcagggaattcggggtgaatttttccgccttgaacaaaaaagaattgcaggaaaaagagccgcaccttgcgccggtgctcgtcggagcgctgcattggacggatccgacgagcgtcgtcgacccgcaggggctcgcgctggcgtatttgaagctgttcgaaagcaggggaggcaagttcgttcagggaaacgcgctttcgctcgaagccggctggaaggtgcaaaccgtcgaaggtcccgtgcaggcggaccatgtggtggtcgcgctcgggccgtgggcggacctggtcacgaggaagttcggctacgacctgccgctcgcggtgaagcgcggctaccacatgcactaccgcgcggcgggcaaggcgatgctgaaccacccgatcctggacaccgagcgcggctacctgctcgcgcccatgcggcgcggcatccgcctcacgacgggcgcggaattcgcgcggcgcgacgcgatccgcacgccggtgcagctcgggcgcgccgagccgattgcgcgcgacctcttcccgctggccgagcgcgtggacacggaagcctggatgggcgcgcgcccgtgcacgccggacatgatgcccatcatcggccccgcgccgcggcacacgggcctgtggttcgcgttcggccacgcgcaccacggcctcacgctcgggccggtgaccggccgcctgatcggtgagatgatcgccggcgagaagccgttcgtggatccgcatccctaccgggccgaccgcttctag

SEQ ID NO: 794 - protein, 410 aa, Unknown
  Obtained from environmental sample
  DOMAIN (4)...(392): FAD dependent oxidoreductase
  SITE (72)...(75): N-glycosylation site. Prosite id = PS00001
  SITE (167)...(170): N-glycosylation site. Prosite id = PS00001
MKVDAVVLGAGMVGIPVALHLQARGRSVVLVDRRGAAEETSYGNAGLIQREGVYPYGFPHDFGALLRYGFNRTIDAHYHPSALLDLAPFLWKYWHHSRPARHAEIARLYARLIEHCVTEHDALAQEAGATDLIKRKGWMRVIRTERQRDKLFAEAEQWRREFGVNFSALNKKELQEKEPHLAPVLVGALHWTDPTSVVDPQGLALAYLKLFESRGGKFVQGNALSLEAGWKVQTVEGPVQADHVVVALGPWADLVTRKFGYDLPLAVKRGYHMHYRAAGKAMLNHPILDTERGYLLAPMRRGIRLTTGAEFARRDAIRTPVQLGRAEPIARDLFPLAERVDTEAWMGARPCTPDMMPIIGPAPRHTGLWFAFGHAHHGLTLGPVTGRLIGEMIAGEKPFVDPHPYRADRF

SEQ ID NO: 795 - DNA, 2310 bp, Unknown
  Obtained from environmental sample
atgaatgcggtcacccgcgaaacgacccttgatgacaaatacgtcttgttgcgtggcaaagtttacctcagcggcatccaggcgctggtcaggcttccacttgacattgtccggcgcgaccgttcggcagggctgacgacggcggcatatgtttcgggctatcgcggctcgccgctggccgggtacgatcagcaacttgtcaaggcaaagcgcttcctcgatgaacacggtgtcgtattccagccgggcgtcaacgaggaattggccgcgaccgccgtctggggcacccagaaggtcggattgcatgggccatcggactacgatggcgtggccggcatctggtacggcaaggcccccggggtcgaccgcacgctggacgtgtttcggcacgccaatgccagcggcaccgccggggcaggcggcgtgctagcgctggccggcgatgatcacctcgcgaaatcgtccagccttcctacccagagcgaattcgcgttcatgcacgccgagatgccggtgctaagcccgtccgatctgcaagatgtactggactacgggatgcacggcatcgcgctttcgcgcttcgccggtgtctgggtcgggcttattgcgcttgccgacacgatggattcctctggaatcgtgtgcgtcgaccccgatcgtctggccgcgcgccggccgatcgacattgccgatccgcgcacggttgccgagttgaaccagccgacgcgcctcgacacccgcctgcagaccgaagtgctgatgcgcgaattgcggctgcctgccgcgcaggcctacgtccgggcgaacgggctcgatcgccgcgaattcggcgcagaacgtgcgcgtctcggcatcatcgcgtctggcaaggcgtaccgtgatctgcgccagacgctggacctgatggggatcagcgaggaggccgcccgcgaccttgggctggccgtcttcaaggtagccatgccgtggccgctcgagccggaggcgatcggcgggttcgtgcgtggcctcgaccgggtcctcatcgtggagaacaagcggcccgtcatcgagccgcagctcaaggacatgctctaccactggccagcgaccttgcggcccgaattgtggggaaagcaccggccggatggtcgcgatctgctccccgagattcgcgagtgcgctcccgattccatcgccccggcgctgctggctttcctgccgaaatccgagcaatccccggaaatgcgggcggcagcggagcgaatcgcggcgcgcattgactgggcccaggatcacgcagccgattccagtcgtagtgcctatttctgctccggttgcccgcacaacacctcgaccctgacgccggaaggcagccgcagccagccaggcattggctgccatgccatgaccgagacagcacagcgcaccaccgatggcttggtcgccatgggcggggagggggtgccttggatcggacagcaccatttttccaaggacggccacgccttcgcgaatctcggcgacggcacctattatcattccggcatactggccatccgtgccgccgtcgccgccaaggcgccgatcacctacaagctcctctacaacgacgccgtggccatgaccggcggtcaaccgatggacgggccgctcgacgtgccgcagcttgtcgcccagcttcacgccgaaggcgtcggtcggatcgtgctggtttcggagcggccggaggcctatcgcaaggcgacgctgccggccggcgtgccggtgcgccaccgcgacgacctcatggaggtgcagcgcgagctccaggcgtatcggggcgtatcggtcatcgtttacgaccagacctgcgccgcggagaagcgccgtcggcgcaagaagggcagctatgaggatctccccacgcgcctgttcatcaaccctcgagtctgcgagaactgcggggactgctcggtgcagtccaactgcatctccgtcgagccgatagagaccgctttcgggcgcaagcggcggatcaaccagtcgagctgcaacaaggactattcctgcgccaagggcttctgcccctccttcgtcgtggtcgacggcgccaggctcgccacggcggccaatcacggcttcgacgtcgaggcgctggccgccgaactccccgtcccgcagatgcacctcggcgaccggccgaccaatctgctgttcacgggcatcggcggcatgggggtgacgacaacggcggcggtgctggcaatggccgcccatctcgacgggctcgcggcggccacgctcgacatgaccggtcttgcccagaagaacgggccggtcctcgtgccg

SEQ ID NO: 796 - protein, 770 aa, Unknown
  Obtained from environmental sample
  DOMAIN (457)...(607): Thiamine pyrophosphate enzyme, C-terminal TPP binding domain
  SITE (134)...(137): N-glycosylation site. Prosite id = PS00001
  SITE (449)...(452): N-glycosylation site. Prosite id = PS00001
  SITE (677)...(680): N-glycosylation site. Prosite id = PS00001
MNAVTRETTLDDKYVLLRGKVYLSGIQALVRLPLDIVRRDRSAGLTTAAYVSGYRGSPLAGYDQQLVKAKRFLDEHGVVFQPGVNEELAATAVWGTQKVGLHGPSDYDGVAGIWYGKAPGVDRTLDVFRHANASGTAGAGGVLALAGDDHLAKSSSLPTQSEFAFMHAEMPVLSPSDLQDVLDYGMHGIALSRFAGVWVGLIALADTMDSSGIVCVDPDRLAARRPIDIADPRTVAELNQPTRLDTRLQTEVLMRELRLPAAQAYVRANGLDRREFGAERARLGIIASGKAYRDLRQTLDLMGISEEAARDLGLAVFKVAMPWPLEPEAIGGFVRGLDRVLIVENKRPVIEPQLKDMLYHWPATLRPELWGKHRPDGRDLLPEIRECAPDSIAPALLAFLPKSEQSPEMRAAAERIAARIDWAQDHAADSSRSAYFCSGCPHNTSTLTPEGSRSQPGIGCHAMTETAQRTTDGLVAMGGEGVPWIGQHHFSKDGHAFANLGDGTYYHSGILAIRAAVAAKAPITYKLLYNDAVAMTGGQPMDGPLDVPQLVAQLHAEGVGRIVLVSERPEAYRKATLPAGVPVRHRDDLMEVQRELQAYRGVSVIVYDQTCAAEKRRRRKKGSYEDLPTRLFINPRVCENCGDCSVQSNCISVEPIETAFGRKRRINQSSCNKDYSCAKGFCPSFVVVDGARLATAANHGFDVEALAAELPVPQMHLGDRPTNLLFTGIGGMGVTTTAAVLAMAAHLDGLAAATLDMTGLAQKNGPVLVP

SEQ ID NO: 797 - DNA, 1437 bp, Unknown
  Obtained from environmental sample
atgacaacgcaagcagccgaagaggtcatcgcccgattgtccgggctgctgggaacggcggccgtgctcggcccggacgatgacatcgcgcgttatgtcaacgagccgcgtggtcgctaccacgaccggccgctggcggtggtgcgtccggcttccacccagcaggtggcggcgaccgtggcgctgtgtcgcgaggcgggcatcgcggtggtggcgcagggcggtaataccggcctggtcggtggcgcctcggtcaccggcagcggtcgcgagatcctgctttcgctcgagcggctgcgcgctatccgccaggtcgatgccgagggggccaccctcatcgtcgaggcgggttgtccgctcgcgcgtgtgcaggaagcggctgccagtgccgggctgctgttccccttgagcctggcttctgccggcaccgccaccattggtggcaacattgccaccaatgccggcggccatctcaccgtgcgccacggcaatacccggcgccaggtgctgggcctggaggtggtgcttgccgatggccgcatctacaacgggctgtcggctctgcgcaaggacaacagcggctacgatctgaaccagttgttcatcggttcggagggtactctcggcatcatcacggctgcgtcactggctctggcgccggcctcgcgccagagcctgaccgccctggtcggactcgattccctgcccgaggtgctggccctgctcaaactcatgcgttcccgcctgggcgagaccctctcggccttcgagatgatgccgcgcctggccatggaattcgtgctcgaataccttgatgtacatgaccctctcggccaccgccacgactggtacgtgttcgttcaggccgacagcgccgtgaccgggagctggctgcgcgagacctgcgtcgaggcgctggaggcggctgccagcgaagggctagcgcgcgacgtggtcgtggccggcaacgatgcccaggccgatgcactgtggcgcctgcgcgaatcggtatcaccggcgcagaagttgggtggcgtcagcctcaagcatgacatctcggttccggtggccgccatcccggctttcatggaagacaccgttgccgcgctcgaagcgctcgtgcccggcattcggccgtgcgtgttcggtcatgtcggcgacggcaacctgcatttcaatcttgcccagccgatggccatgggcgccgaggcctttcgagcccgcgaggacgagtgcaaccgcattgtcttcgaccgtgttgtgcgccacggtggttcgattgcggccgagcacggcatcggtcgcctgcgctcggccgagctggcccggtgtgccgacccggtgcgcctggacctgctgcgtcgcctcaagcactgtctggatcccgaggggctgctcaaccccggcaaagtggtggagaaatcaagcaatgactga

SEQ ID NO: 798 - protein, 478 aa, Unknown
  Obtained from environmental sample
  DOMAIN (44)...(185): FAD binding domain
  DOMAIN (221)...(471): FAD linked oxidases, C-terminal domain
MTTQAAEEVIARLSGLLGTAAVLGPDDDIARYVNEPRGRYHDRPLAVVRPASTQQVAATVALCREAGIAVVAQGGNTGLVGGASVTGSGREILLSLERLRAIRQVDAEGATLIVEAGCPLARVQEAAASAGLLFPLSLASAGTATIGGNIATNAGGHLTVRHGNTRRQVLGLEVVLADGRIYNGLSALRKDNSGYDLNQLFIGSEGTLGIITAASLALAPASRQSLTALVGLDSLPEVLALLKLMRSRLGETLSAFEMMPRLAMEFVLEYLDVHDPLGHRHDWYVFVQADSAVTGSWLRETCVEALEAAASEGLARDVVVAGNDAQADALWRLRESVSPAQKLGGVSLKHDISVPVAAIPAFMEDTVAALEALVPGIRPCVFGHVGDGNLHFNLAQPMAMGAEAFRAREDECNRIVFDRVVRHGGSIAAEHGIGRLRSAELARCADPVRLDLLRRLKHCLDPEGLLNPGKVVEKSSND

SEQ ID NO: 799 - DNA, 1281 bp, Unknown
  Obtained from environmental sample
atgactgaagcttcccctcgacacgtgactgtcatcggcggtggcgtggttggaacgaccaccgcattggccctggccgagcgcgggctggaggtcaccctggtcgagcgctgccaccaggccgccgaggagaccagcctggccaacgggggggggctcaccccggcccatgccgagccctggaatgcacccggcctgctcggcaagctggtgcgcaatctcggccgcgcggatgcgccctatcggctatcgccgctggccgtgccgggcatgggcctgtggggactgcgctttctggccaacatgcgccgcgagcgtttcatggccaatgcgcgcagcaacattcgactggggttgtattcgctggaatgcctgcggcgctggcgtgaaagccatggcatcgagtacgaccagacgctgtcgggttccatgcaggtgtatttctcgcgcgaactgatggccgaatcggtgcagttccggcgcgagctgctcgatggcgcggccgagatcgagccggtgggtatcgacgaggcgattgcccgagaaccggccctggccccggtccggcgccgactggccggggccatcgtctttcccgatcacgaatccggtgatgcctgccgcttcagccgggcggcgctggacctggcctttgagcggggtgccaaaaccctgctcgacacggccgtccgttcgattcgagtggaccagggtcgcgtccaggccgtggtcaccgaccagggcgagatcgactgcgatgcctgcgtggttgcagccggcccggcctcggccaggctggtgcggccgctgggcttgcacctgcccatctatcccgtgcgtggctactcggccacgttcgagatcgaccgcaccgacgcgctgccgaccctgccgatgctggataccgccagccgcttcgtcacgcttcgcctgggtgagcgtggcctgcgcatcgccggcctggccgatttcgctggcccgcatcgccgcattcgcccacggcgcatcgccagcctgctggcgggcgcgcgccgcctgctgccggaactggcctcggaactggccgtggagcgcgccgaactgtgggcaggcctgcggccggtgacacccgatggggtgcccctgctcgggcccacccgcatcaccggcttgcacgtcaatgcaggccatgggcccatgggctggaccatggcctgcgggtcggccgacctggtggcggccggcctttgtggggaggaaccccgaatcgagatggatgcctacggcgtcgcgcgacgctga

SEQ ID NO: 800 - protein, 426 aa, Unknown
  Obtained from environmental sample
  DOMAIN (8)...(408): FAD dependent oxidoreductase
MTEASPRHVTVIGGGVVGTTTALALAERGLEVTLVERCHQAAEETSLANGGGLTPAHAEPWNAPGLLGKLVRNLGRADAPYRLSPLAVPGMGLWGLRFLANMRRERFMANARSNIRLGLYSLECLRRWRESHGIEYDQTLSGSMQVYFSRELMAESVQFRRELLDGAAEIEPVGIDEAIAREPALAPVRRRLAGAIVFPDHESGDACRFSRAALDLAFERGAKTLLDTAVRSIRVDQGRVQAVVTDQGEIDCDACVVAAGPASARLVRPLGLHLPIYPVRGYSATFEIDRTDALPTLPMLDTASRFVTLRLGERGLRIAGLADFAGPHRRIRPRRIASLLAGARRLLPELASELAVERAELWAGLRPVTPDGVPLLGPTRITGLHVNAGHGPMGWTMACGSADLVAAGLCGEEPRIEMDAYGVARR

SEQ ID NO: 801 - DNA, 1257 bp, Unknown
  Obtained from environmental sample
atgcatgtgatcgtgattggcgccggggtggtgggctcgaccaccgcactggccctggctgaacgcggacttgaagtcacgttgatcgagcgccacggcgaaccgggtgccgagaccagtcatgccaacggtggtggcatcacaccaggccatgccgaaccgtggaattcgccaggcattatccgtcgcctgctgacccgctccggcgagggcgagccgtttcgtatccggcctggagccctgccgggactgtccggctggggcctgcgctttctggccaattcgcgtcccggccgctactacttcaatgcgcgggccaatacccgcctggcggtatattccggtcactgtttgaaagccctgcgcgagcgattcgagctgaactatcaccagtacaccgatggttcgctggagctttacttcagccaggccgaactggaccacgccctggagttgcgtcgccgaatcggtgatccgggtgtggagattcacctgcttggcgttcgcgaagccgtggcgctggagccggcgctggagccgatcgccgcccgactggtcggggccatgcaattgccactgcacgaatccggcgatgcctgcgagttttccgccgaaatggtgcgttgcgcccgcagtctgggcgcgcgcgtcctgttcgataccgaagtggtcaccatcaaccggaacaacgaccggatcagtggggtgcagacggacaaggaaaccatcaacaccgatgcggtcgtgctgtcagccggttgcgccagcccgagcctggcccggccgctgggcttgcgactgccgatctatccggtcaagggctactcggccaccctcgaactcgaccaggttgaactggccccgaccatgccgctgctggatctggagcaacgcattgtcaccgcccgctatggccgacgattgcgcatggccgggctggcagatttcgagggccatgaccgaagtgttcgtcccgaacgaattgcccgcctgctcgaatcggcggccaccctgctgccggcactggccgatgaaattcactccggaaaggccgaaccctgggcgggacttcgccccatgacccccacgggcccaccgatgctcggcccgacccggattcccggactgtatctgaacaccggtcatggctccatgggttggacccaggcggccggctcggccgaagtcctggccgatctggtgaccggaaaaacgccggtgatcgacatgagggggttggaggcggtaaaaggttga

SEQ ID NO: 802 - protein, 418 aa, Unknown; identical to SEQ ID NO: 734
  Obtained from environmental sample
  SIGNAL (1)...(18)
  DOMAIN (2)...(400): FAD dependent oxidoreductase

SEQ ID NO: 803 - DNA, 1257 bp, Unknown
  Obtained from environmental sample
atgccaccgcatgtgatcgtggtcggagccggcgtggttggcgccagcacggcgctgagcctggccgagcgcgggctggcggtgaccgtgcttgaccgccagccgcaggctgcggccgaaaccagccatgccaacggcggcggcatcacgcctggccatgccgaaccctggaacgcgcccggcatcatccaacgcctgctgactcgttcgggcaccggcgagccgttccgcattcatgctcacgctttgccgggcctggtcagctggggtctcaattttctgtggcagtcgaaggcgtcgcgctattaccgcaatgccaagaacaatacccgcctggcggtgtattccggccagtgcctgaagcgcctgcgcgagcgtcatcagctgagctatcaccagtacacggacggctcgctcgagctttatttcagccagtccgagctggaccatgccctggacctgcgacgcaaaattgacgatcccggcgtcgagatccgggtcatcgatgccgacgaagtcgtcgccatggaaccggcgctcgagccggtggcggggcgcatggctggcgcgatgttcctgcccctgcatgagtctggcgatgcctgtgtcttttcagccgaaatgctgcgctgtgctgaatcgctgggcgcgaagatccggctgggcgccaatgttcagcgcatcgaacagcaacacggccgggttattggcgttcgcttggcagacgggcatctactcgaagccgatgccgtgatcgtggccgccggctgtggctcgccggcgctggtcaaaccgctgggcctgcgcctgccgatctatccggtcaagggctactcggcgacgctggcgctcgagcaggccgagctggcaccgaccatcccgctgctggacctggaacaccgtatcgtcaccgcccgcttcggtaatcgcctgcgcatggccggcctggccgacttcgacggctacagccgcagcattcgcactgaccggatcgagctgttgctcgaatccgcctgcgccctgctgccgcgccttgccgaagaaatccgctccggccgcgccgaagcctggactggtcttcgcccgatgacacccaagggcacagcgctgctcggacccacccgtattcccggcctctacctgaataccggccacggctccatgggctggacccaggccgccggctcagccgagatactggccgatctgttgaccgaacgggcgccggcgatcgagctggctccgttcgctctctag

SEQ ID NO: 804 - protein, 418 aa, Unknown
  Obtained from environmental sample
  DOMAIN (4)...(403): FAD dependent oxidoreductase
  SITE (109)...(112): N-glycosylation site. Prosite id = PS00001
MPPHVIVVGAGVVGASTALSLAERGLAVTVLDRQPQAAAETSHANGGGITPGHAEPWNAPGIIQRLLTRSGTGEPFRIHAHALPGLVSWGLNFLWQSKASRYYRNAKNNTRLAVYSGQCLKRLRERHQLSYHQYTDGSLELYFSQSELDHALDLRRKIDDPGVEIRVIDADEVVAMEPALEPVAGRMAGAMFLPLHESGDACVFSAEMLRCAESLGAKIRLGANVQRIEQQHGRVIGVRLADGHLLEADAVIVAAGCGSPALVKPLGLRLPIYPVKGYSATLALEQAELAPTIPLLDLEHRIVTARFGNRLRMAGLADFDGYSRSIRTDRIELLLESACALLPRLAEEIRSGRAEAWTGLRPMTPKGTALLGPTRIPGLYLNTGHGSMGWTQAAGSAEILADLLTERAPAIELAPFAL

SEQ ID NO: 805 - DNA, 1323 bp, Unknown
  Obtained from environmental sample
aaagaattcggcacgaggtgttatcgggcgcaaccgctcgcggtggcgcgcccggccagcctgaaggaaatggccgacgcggtcaggcagtgcgcgcaagccggcgtgccgatggtggcacagggtgggcataccggtctggttggaggcgcggttgctgggccgaatgaaatcgtcctgagcctggagcgcatgaatcgcgttcgcaggcttgatgagcacgatgccagcatggtggtcgaggccggttgcacattggccgaagtgcgggcaaaagctgccgcgtcgggcctgttctacccggtcagtctggcctcggaaggtacggccaccataggcggtaccctggccaccaatgccggcggcaatctcaccatccgctatggcaatacccgggagcaggtgctgggccttgaggtggtgctggccgacggtcaggtctggtcggaccttgatcctttgcgcaaggacaacagcggctacgatcttaaacaagtgttcatcggcagcgaaggcaccctgggcatcatcacggcggccacgctgaagctggcgcccgcgccgcgccagagcctgacggcgatgctggcctgtgctgatctgcccacggccatggccctgctcaagcatctgcgcgcgggcctgggcgagtgtctgtcggcctgcgagttcatgccgcgcctggcgatggagttcgtgctgctggaccagccggcgcagcgggatcctttcgattcaccgcatccctggtacgtgctggtccaggcggactccagcctgccgggagacagcctggagcaggctgctcacagcgttttgcaccaggcattggagagcggactctgccgcgaccttgtggtggctgtcagcgaggcacaagtcagggccttatggtccttgcgcgagggtatctcggcggcccaaaagcatggcggagccagcatcaagcacgacatcgccgtgcccgtggccagcattcccgagttcgtggctgaaacggtcgcggcgctggaacggcgcgtgacaggcattcgcccctgcatcttcggccatctcggcgacggcaatctgcatttcaacctcagccagccggcgcacatggacgcggagcggttccgcgccctggagcctgactgcaatcgcatggtgtttgaccaggtcaggcgctaccgcggctccatcgccgccgaacacgggatcggtcaactgcgctgcgaggagctggcccgtggtcaagcggacaaggtcgagctgatgcgccgggtcaagcaggctctggatcccgatggactattgaatccgggcaaggtcttgcggccgtag

SEQ ID NO: 806 - protein, 440 aa, Unknown
  Obtained from environmental sample
  DOMAIN (12)...(151): FAD binding domain
  DOMAIN (187)...(437): FAD linked oxidases, C-terminal domain
  SITE (124)...(127): N-glycosylation site. Prosite id = PS00001
  SITE (131)...(134): N-glycosylation site. Prosite id = PS00001
  SITE (365)...(368): N-glycosylation site. Prosite id = PS00001
KEFGTRCYRAQPLAVARPASLKEMADAVRQCAQAGVPMVAQGGHTGLVGGAVAGPNEIVLSLERMNRVRRLDEHDASMVVEAGCTLAEVRAKAAASGLFYPVSLASEGTATIGGTLATNAGGNLTIRYGNTREQVLGLEVVLADGQVWSDLDPLRKDNSGYDLKQVFIGSEGTLGIITAATLKLAPAPRQSLTAMLACADLPTAMALLKHLRAGLGECLSACEFMPRLAMEFVLLDQPAQRDPFDSPHPWYVLVQADSSLPGDSLEQAAHSVLHQALESGLCRDLVVAVSEAQVRALWSLREGISAAQKHGGASIKHDIAVPVASIPEFVAETVAALERRVTGIRPCIFGHLGDGNLHFNLSQPAHMDAERFRALEPDCNRMVFDQVRRYRGSIAAEHGIGQLRCEELARGQADKVELMRRVKQALDPDGLLNPGKVLRP

SEQ ID NO: 807 - DNA, 1329 bp, Unknown
  Obtained from environmental sample
atgcatatcgtcgtaatcggcgcaggggtgatgggtgtgaccacggcttatgctttgagtcagcgtggtcacagggttacggttatcgagcagttatccagtgccgggcaggagaccagccgggccaatgccgggcagcgcagctatggctatgtttatccctggtcctctccggcgatgatcaaaaaggcgctgccctggctgttgcagaaggatggcccattgaagatgcagatgccgccgagccttgacgcactgcgctttctgtttgccacctggcgttatgcaaaaccgggtatcttcgaggccaacaaacgcgccatgctgcaactcgccgcctacagtcgtgagtgcttccataccctggaggctgaactgtcacttgcgtttgatggtgagcagggtggggtgatggagctggccagcgatgcggccagcgcagcgagtcttcagtcagccttgccgttgctgcgcgaagtcggcgtgccgcatcgcttcctgaacgcggaggaaaccctggcgcaggaaccggccttgtcggggcacggtcctttgctgggtgcgctgtggttgccggaggatggcaccggcgactgctgccacttcagtcaggcgctggcggctgcctgtgagtctcggggtgttgagtttcgctacaacacgcgggtggtttcggcagagctggagcgtgagcaggtggtcggattgctgctcaggcctgctgatgaggatcaggtatattcagggccaaagtcaaaacaggagtcagaacccggctctgaacaggcgccagaactgttgcaggcggatgcctatgtgctttgcgccggaaccgagtccaaccgtctggggcaactgtttggcagtcggctgatgatctacccggtcaagggctactccctgaccgccccgctgctcgaccctgataaagcgccgcgctactcggtgatcgatgatcgcttcaaggtggtcacgacacggctgggttcgcggatgcgcgcgaccggctttgtcgagctgaccggtatgaatcgcgagatacccgaggcgcgtcttgatacgattcgccgcgccgtggcgtcgcgttttccgggggcagcggatatgagtcaggctgagccctgggcaggatttcgacccatgacgccggatggcccgccgctgatcggtcgtggccagtatcacaacctctatctgaacaccgggcatggcacctttggctggacactgtcggcggcgagtgcacaggtgattgcacaactggtggatggtgaggcgccggcagtagcgctggacgctttccgaccggaccggttcgaaccgacctga

SEQ ID NO: 808 - protein, 442 aa, Unknown
  Obtained from environmental sample
  SIGNAL (1)...(18)
  DOMAIN (2)...(421): FAD dependent oxidoreductase
MHIVVIGAGVMGVTTAYALSQRGHRVTVIEQLSSAGQETSRANAGQRSYGYVYPWSSPAMIKKALPWLLQKDGPLKMQMPPSLDALRFLFATWRYAKPGIFEANKRAMLQLAAYSRECFHTLEAELSLAFDGEQGGVMELASDAASAASLQSALPLLREVGVPHRFLNAEETLAQEPALSGHGPLLGALWLPEDGTGDCCHFSQALAAACESRGVEFRYNTRVVSAELEREQVVGLLLRPADEDQVYSGPKSKQESEPGSEQAPELLQADAYVLCAGTESNRLGQLFGSRLMIYPVKGYSLTAPLLDPDKAPRYSVIDDRFKVVTTRLGSRMRATGFVELTGMNREIPEARLDTIRRAVASRFPGAADMSQAEPWAGFRPMTPDGPPLIGRGQYHNLYLNTGHGTFGWTLSAASAQVIAQLVDGEAPAVALDAFRPDRFEPT

SEQ ID NO: 809 - DNA, 1242 bp, Unknown
  Obtained from environmental sample
atggatttcgatgtaatcgtgttgggcgccgggatcgtcggcgtgtcgtcggcgctgcatctgcaggatcgtggccgccgcgtggcgctcgtcgatcggcgcggccctggtgaagagaccagtttcggcaatgcaggtctgatcgagcgctcgtcggtggtcccttacgcgtttccgcgcgatttcggaacactgctgcgctacatgcgcaatcgttcgatcgacctgtactgggactataaggccgtgccgtcttttgccgcgtggctcgcgcgattctggcgggagtcgtcgccggagcgcttggaagcggccgcgcgcgacatgctgccgttgatccgccagagcgtcgacgaacacgatgtgctgatcgagcgtgccggtcttcagagactcgcgcatgacggcggctggatcgaggcatttcgcacgcgctccgaatatgaacggcaggcatcagccgccgaagtcaccgcgagtcggtatgggttgcgcgtggcggcgctcgatgccgcgcggctgctggcgcgcgagcctgggttgggcagcggtttctgtggcgccctgcattggcaggacccgaagagtatttccaacccaggcgcgttgacgaagggatatgcacggttgttcgaggacggcggcggaacgttgctgaccggagaggcaagtacggtgcgtcaggaggccgatgcgtggactgtgcagacgtcccaaggcaggatcagtgccaacgaggtggtcgtggcactcggtccgtggtccgataaagtttttgagccgcttggatatcgcataccgctgcgcgcgaagcgcggctatcacatgcactacgaggccacgaaaccactgctctcggtgccgcttgtggatacggagcgagggtacgtggtggcgccaatggaaggccgcttgcgtttgacgacgggtgttgaaatcgcccgccgggatgcaccgccgacgggtattcaacttgcgcgcgcagaaagcgtcgcccggccggttttcggtttggggcgccggctggacgacgcgccttggatcggcttgcgtccctgcacgccagacatgcggcccgtcatagggcgagcgcctcgccatcgaggactctggttcgcgtttggccacaaccaccacggattgacgatcggtcccgtgacgggccgtttgctggcggaaatgatgacgggcgcgacgccttgcgccgatccctatccgtttcgtcccgagcggttccggtaa

SEQ ID NO: 810 - protein, 413 aa, Unknown
  Obtained from environmental sample
  DOMAIN (4)...(394): FAD dependent oxidoreductase
  SITE (72)...(75): N-glycosylation site. Prosite id = PS00001
MDFDVIVLGAGIVGVSSALHLQDRGRRVALVDRRGPGEETSFGNAGLIERSSVVPYAFPRDFGTLLRYMRNRSIDLYWDYKAVPSFAAWLARFWRESSPERLEAAARDMLPLIRQSVDEHDVLIERAGLQRLAHDGGWIEAFRTRSEYERQASAAEVTASRYGLRVAALDAARLLAREPGLGSGFCGALHWQDPKSISNPGALTKGYARLFEDGGGTLLTGEASTVRQEADAWTVQTSQGRISANEVVVALGPWSDKVFEPLGYRIPLRAKRGYHMHYEATKPLLSVPLVDTERGYVVAPMEGRLRLTTGVEIARRDAPPTGIQLARAESVARPVFGLGRRLDDAPWIGLRPCTPDMRPVIGRAPRHRGLWFAFGHNHHGLTIGPVTGRLLAEMMTGATPCADPYPFRPERFR

SEQ ID NO: 811 - DNA, 1242 bp, Unknown; identical to SEQ ID NO: 809
  Obtained from environmental sample

SEQ ID NO: 812 - protein, 413 aa, Unknown; identical to SEQ ID NO: 810
  Obtained from environmental sample
  DOMAIN (4)...(394): FAD dependent oxidoreductase
  SITE (72)...(75): N-glycosylation site. Prosite id = PS00001

SEQ ID NO: 813 - DNA, 1242 bp, Unknown; identical to SEQ ID NO: 809
  Obtained from environmental sample

SEQ ID NO: 814 - protein, 413 aa, Unknown; identical to SEQ ID NO: 810
  Obtained from environmental sample
  DOMAIN (4)...(394): FAD dependent oxidoreductase
  SITE (72)...(75): N-glycosylation site. Prosite id = PS00001

SEQ ID NO: 815 - DNA, 1242 bp, Unknown; identical to SEQ ID NO: 809
  Obtained from environmental sample

SEQ ID NO: 816 - protein, 413 aa, Unknown; identical to SEQ ID NO: 810
  Obtained from environmental sample
  DOMAIN (4)...(394): FAD dependent oxidoreductase
  SITE (72)...(75): N-glycosylation site. Prosite id = PS00001

SEQ ID NO: 817 - DNA, 1269 bp, Unknown
  Obtained from environmental sample
gtgaaaattctcgtcctgggcgccggtgtggtgggtacggccacggccctggctctggcccggcgcggcctggacgtgaccctgatcgagcgcgagggggagcccgcccgcggcaccagccacgccaacggcgggggcatcaccccggcccacgccgaaccctggaacgcgccgggcatcggctggatgctggtgcgctggctcggccgccgcgacgcgccgttccggctcaggccctcggcgatcccgggcatgacgcgctggggactggcctttctggccaactccaggcgcaggcgcttcatcgaaaacgcccgcgccagcatccgcctggcggtgtattcgggacaacggctgaaggcctggcgcgatgaactggagctggaatacgggcagcgcacgctgggctcgatcaaggtcttctggacccgtcgcgagctggataagtccctgaaactgctgaccggcgtcggccatccagaggtggcctggaaggcgttgtcgccggccgaggcggtggagctcgagcccgccctgggcccggttgccgaaaggctggccggcacgctgcactttcccggcaacgagtcgggcgacgcccgccggttcagcctggccgcggccgagaaggcgcgcgagctcggcacgcggttgcagttttcaaccgccgtggagtccatcgaatgcgacgcctggggtttccggagcgtgcgcacgagccagggtgatttcgaggccgaggcctgcatcgtgtgcctgggctgcgacagtccggcgctgctcaacccgctgggcgtgcgcgtgccgatctacccggtcaagggctactcggccacccttgagcttgacgatcccgccgccgcgccggctggctgcgtgctcgacgcgggccaccgggtgatcgtcacccggctgggcgagaaggtgctgcgagtggccgggaccgccgagttcgctggccacgacctggaaatcgaccgggtacgggcccgctcgatgctcgacagcgcactggcggtgtttccggcgctgggccgggaaatcgagggacgcgagcccgagttctggaccgggctgcgccccatgaccccggatgggccgccgctgctcggccgcgccggcccgcgcggggtctggctgaacaccggccacggctccatgggctggacccaggcggccggctcggccgagatcctggccgacctgatctccggaaagtcgccggccatcgacgtgtccgggctcgaagcagcgcgctggaaccagtaa

SEQ ID NO: 818 - protein, 422 aa, Unknown
  Obtained from environmental sample
  SIGNAL (1)...(18)
  DOMAIN (2)...(402): FAD dependent oxidoreductase
MKILVLGAGVVGTATALALARRGLDVTLIEREGEPARGTSHANGGGITPAHAEPWNAPGIGWMLVRWLGRRDAPFRLRPSAIPGMTRWGLAFLANSRRRRFIENARASIRLAVYSGQRLKAWRDELELEYGQRTLGSIKVFWTRRELDKSLKLLTGVGHPEVAWKALSPAEAVELEPALGPVAERLAGTLHFPGNESGDARRFSLAAAEKARELGTRLQFSTAVESIECDAWGFRSVRTSQGDFEAEACIVCLGCDSPALLNPLGVRVPIYPVKGYSATLELDDPAAAPAGCVLDAGHRVIVTRLGEKVLRVAGTAEFAGHDLEIDRVRARSMLDSALAVFPALGREIEGREPEFWTGLRPMTPDGPPLLGRAGPRGVWLNTGHGSMGWTQAAGSAEILADLISGKSPAIDVSGLEAARWNQ

SEQ ID NO: 819 - DNA, 1263 bp, Unknown
  Obtained from environmental sample
gtgcatgtagtcgttctgggtgcaggcgttgtgggcaccacaacagcgctggccttggccgaaggcgggcatcaggtcacggtcatcgaccgtcagccaggccctgcccttgaaaccagctttgccaatggcgcgcagatttccgcctgccatgcgaaaccttgggctgcgcccgacgttccgttccaggccttgaaatggatgtttcagcccgatgcgccgttgctgttccggcccatgcggtgggacccgcccttatgggcgtggggcttgcggtttttacgcaactgcacccctgagcgcgtgcgcaccaacatgggccgcgcgttacgcgtatcactgtacagccgtgatgtgctgcgcgcattacgccaacgcaccaacattcagtacaaccaagtcttaagcggaatcttgcacatctaccgcacgcgcgaggagtttgccgctgggcgcgccaatgccgccaacctggaactgctgggcttgccgcaggaaatcttaagcccaaccgattgcgtgcgctacgaaccggcattggagcatgcagccaagactgatctcgtcggcggcttgatgagccccgccgatgaaagcggcgatgcgcggttgttcaccgaagaagtcatgaaactggcccaagcaaaaggcgcggccttccggtggaacgagactgttgtgaaactggaagcctcaggtcgcaaaatcacgcgcgtcatcaccagcgccggagacataacggccgatgcgttcgtgcttgctgctggaagttacagcccgatgctggcgcgcgaccttgggctcgcgctgccgatctatccggccaagggctattccatcagcaccgagatcactgtgccgcatgcggccccgaccatcagcgtcaccgatgaaacgcgctacatggtgttttcgcgcctgggcaatgtcatgcgcgtggcgggaactgcggaacttgcgggctggaacaccaagcttgatccggtgcgtgtggcccctttggtcgcgaacgccaaagcgctgttccccacggcctcagcctacaccgacgtcaacccgtggtgcggcttgcgccccaccacgccggactcggttcccatcctgggccgcacgcggattgaaaatctgatgttgaacaccggccacggcacactgggctggacgatggccgctggctcggcgcacatcatcgccgacctgatggccggccgtacgcccgagatcgatatgaatggtttgggattagaccgctttggcgcttag

SEQ ID NO: 820 - protein, 420 aa, Unknown
  Obtained from environmental sample
  SIGNAL (1)...(20)
  DOMAIN (2)...(400): FAD dependent oxidoreductase
  SITE (226)...(229): N-glycosylation site. Prosite id = PS00001
MHVVVLGAGVVGTTTALALAEGGHQVTVIDRQPGPALETSFANGAQISACHAKPWAAPDVPFQALKWMFQPDAPLLFRPMRWDPPLWAWGLRFLRNCTPERVRTNMGRALRVSLYSRDVLRALRQRTNIQYNQVLSGILHIYRTREEFAAGRANAANLELLGLPQEILSPTDCVRYEPALEHAAKTDLVGGLMSPADESGDARLFTEEVMKLAQAKGAAFRWNETVVKLEASGRKITRVITSAGDITADAFVLAAGSYSPMLARDLGLALPIYPAKGYSISTEITVPHAAPTISVTDETRYMVFSRLGNVMRVAGTAELAGWNTKLDPVRVAPLVANAKALFPTASAYTDVNPWCGLRPTTPDSVPILGRTRIENLMLNTGHGTLGWTMAAGSAHIIADLMAGRTPEIDMNGLGLDRFGA

SEQ ID NO: 821 - DNA, 1242 bp, Unknown; identical to SEQ ID NO: 737
  Obtained from environmental sample

SEQ ID NO: 822 - protein, 413 aa, Unknown; identical to SEQ ID NO: 738
  Obtained from environmental sample
  DOMAIN (4)...(395): FAD dependent oxidoreductase
  SITE (97)...(100): N-glycosylation site. Prosite id = PS00001
  SITE (239)...(242): N-glycosylation site. Prosite id = PS00001

SEQ ID NO: 823 - DNA, 1170 bp, Unknown
  Obtained from environmental sample
atggcgaaatatgacgtggtcatcatcggcggggcgatcgtcggcagctccgtcgcctactatctgcgcgaggaaggttttaccggctcgatcgcgctggtcgagcgtgatcctcaattctcgtattccgccacgactctctcctgcgcctcaatccgccagcagttctccattccggaaaacatccgcctgtcgcagttcacgctggggctcttccgcaggctgaaggaggagttcggcgccgacgccgacatcgcgttccgggaaaacggctacctcattctcgcgaccgaagaaggcctgccggtcctggcggccaaccatgccgcgcaggaggccgaaggcgccgacatcctgctcgaggaggccggggcgctggcgcgccgcttcccctggctgtcgacggacgggatcgccgccggggcgttcgggcgcgccggcgaaggctggttcgacgcccatgcctacctgcagcttttccgcaaggcgcttcgcacgaagaaggtcgatttcatcaacgcttctctggtcagcctggagcggcagggcgatcgtgtcgccaccgcggtgctcgacgacggccagcggctggagacggggatagtggtcaacgcggcggggccgagcgccggcaaggtctcggcgatggccggaatcgcgctgccggttgagccgcgcaagcgttcggtcttcgttttcgaggcctatgacttgttccccgacatgccgctggttgtcgatccgagcggcgtctatgtgcgcccggagggcacggtctacatcgccggcggcggggaagccgaagaaaccgacggcccggccgaccccggcgatttcgatccggactgggcgctcttcgaggagcgcatctggccagcggtcgcaacccggatccccgccttcgaggcgatcaaggcgacacgcgcctgggccggccactacgactacaacaccctcgaccagaacgccgtcatcgggcggcacccgcaagtcgggaacttcatcttcgcgaacggtttttcggggcacggcctccagcaggcgccggcggtcggccgggcgatcgccgagctcatcgtgcatggcggctaccgtacgatcgactgctcggtcttcggctacgaacgcatcgccgccagccggccctaccgcgagctcaacgtgatctag

SEQ ID NO: 824 - protein, 389 aa, Unknown
  Obtained from environmental sample
  DOMAIN (5)...(224): Pyridine nucleotide-disulphide oxidoreductase
  DOMAIN (5)...(358): FAD dependent oxidoreductase
  SITE (175)...(178): N-glycosylation site. Prosite id = PS00001
MAKYDVVIIGGAIVGSSVAYYLREEGFTGSIALVERDPQFSYSATTLSCASIRQQFSIPENIRLSQFTLGLFRRLKEEFGADADIAFRENGYLILATEEGLPVLAANHAAQEAEGADILLEEAGALARRFPWLSTDGIAAGAFGRAGEGWFDAHAYLQLFRKALRTKKVDFINASLVSLERQGDRVATAVLDDGQRLETGIVVNAAGPSAGKVSAMAGIALPVEPRKRSVFVFEAYDLFPDMPLVVDPSGVYVRPEGTVYIAGGGEAEETDGPADPGDFDPDWALFEERIWPAVATRIPAFEAIKATRAWAGHYDYNTLDQNAVIGRHPQVGNFIFANGFSGHGLQQAPAVGRAIAELIVHGGYRTIDCSVFGYERIAASRPYRELNVI

SEQ ID NO: 825 - DNA, 1146 bp, Unknown
  Obtained from environmental sample
atgatggacaaccaagttctcgacttcgccgtgatcggcgcgggcatggccggcgcctcggtggcctggcgactggcaggggcaggcgcctcggtcctggtgctggagcgggagccgcagcccggctaccacgccacgggccgctccgccgcgatgttcatggaaagctatggcaccgagcagatccgcgcgctgacgcgggccagccgcgccttctacgacgcgccgcccgaaggcttttgcgaacacgcgctgctgcagccgcgcagcgtgctctacgtgggaacggtcggccaggaggcacagctcgatgacgccctggccatgtaccgccgcgacggcctgcgcgccgagcgcatcgatgcgcgccaggcctgcgccctggtgccctgcctggatgagacgcagctcgtgggcgccgtgcatgacctggatgccatggacatcgacgtggccgggctgcaccagggattcctgcgcggcatggcgcgcgccggcgcccgcctgcgctgcgctgccgaactggcgggcgccgaacgcgatggccagggcctgtggacactgacgctgcacgacggcacccgggtgcgcgcgcgcgccgtggtcaatgccgcgggcgcctgggccgatgccgtggcacggctgtgcggtgcccaggccctgggcatcgagccccggcgccgctcggccttcaccttcgccgcgcccgaaggcgaggccatccatgactggcccgcggtggtcggcgtggacgagagcttctacttcaagcccgacgcgggccagctgctgggctcgcccgccaacgccgatcccgtggcgccgcacgacgtggtggccgaggagctggacgtggccatcggcatagaccgcatcgagtccctgacccgcctgcgcatccgccggccgcgccatgtctgggcggggctgcgcagcttcgcgcccgacgacgacttcgtcatcggctgggatgtgcggcgcgagggcttcttctggctggccgggcagggcggctacggcatacagacggcggctggcgcctcggccgcggccaccgcgctgctgatgcacgagtcgctgcctggcgaactgctggcccagggcgtcgatgccgcgcggctgagcccggcgcgcttctcggcctga

SEQ ID NO: 826 - protein, 381 aa, Unknown
  Obtained from environmental sample
  DOMAIN (8)...(354): FAD dependent oxidoreductase
MMDNQVLDFAVIGAGMAGASVAWRLAGAGASVLVLEREPQPGYHATGRSAAMFMESYGTEQIRALTRASRAFYDAPPEGFCEHALLQPRSVLYVGTVGQEAQLDDALAMYRRDGLRAERIDARQACALVPCLDETQLVGAVHDLDAMDIDVAGLHQGFLRGMARAGARLRCAAELAGAERDGQGLWTLTLHDGTRVRARAVVNAAGAWADAVARLCGAQALGIEPRRRSAFTFAAPEGEAIHDWPAVVGVDESFYFKPDAGQLLGSPANADPVAPHDVVAEELDVAIGIDRIESLTRLRIRRPRHVWAGLRSFAPDDDFVIGWDVRREGFFWLAGQGGYGIQTAAGASAAATALLMHESLPGELLAQGVDAARLSPARFSA

SEQ ID NO: 827 - DNA, 1272 bp, Unknown; identical to SEQ ID NO: 781
  Obtained from environmental sample

SEQ ID NO: 828 - protein, 423 aa, Unknown; identical to SEQ ID NO: 782
  Obtained from environmental sample
  DOMAIN (14)...(404): FAD dependent oxidoreductase
  SITE (88)...(91): N-glycosylation site. Prosite id = PS00001

SEQ ID NO: 829 - DNA, 1281 bp, Unknown
  Obtained from environmental sample
atgaataagcggacacccgaacgggttgtcgtcattggtgggggcgtggttggtgcctcgaccgcgctggcgttggccgagcgcggcctgcaggtcacactgatcgagcgcaatgccgagctggccgaggagaccagtttcgccaatggcggcggcgttaccccactgcattccgagccctggaatgcgccgggcctgttgtccaaggtggtgcgcaatctcggccgtgccgacgcaccctatcggctctctcccctggccgtgccgggcatgggtttctgggggcttggctttctgcgccacatgcgccctgaacgctaccgggccaatgcccgcaggaatatcgatctggccctttactcgctggcttgcctgcgccagtggcgcgaacgtcattcactggaataccgccagataacggccggctccatgcaggtgtatttttcgcgcgaactgatggccgaatcggtgcagctgcggcgcgaactgctcaaggaccgcgccacgatcgaaactctggatgccgatcaggcggtgacgcgggaaccggccctggccggggtcaggcagcgattggtcggtgcgatctattttcccgatcacgaatccggagatgcctgccagttcagccgcgaagcggccgcccgggccgaggggctgggcgcgcggattcactgtgagacccgggtgcactcgttccggatcgaaggcgggcaattccgggccgtggtcaccgatcagggcgagttcgaggccgatgcctgcgtgatcgcggccggtccggaatcacccaccctggcgcgccaggttggattgcgcctgcccatctacccggtgcggggctattcggccaccttccggatcgactcgaccgaggccctgcccaccctgcccatgctcgatacctcgagccgcttcgttaccgtccgcctgggcgagaacggatttcgcgtcgccgggctggccgatttcgccggtcgccgtcgcgtgatcattccccggcgggtggagagcctgctggccggcgcccgccgcctgctgcccggcctggccgcggaactggtcagcgagcgcgccgagctgtgggccggcatgcgtccggtcacccccgacggggtgccactgatcggcccgacccgaaagcctggcgtattcctgaatactggccatggccccatgggttggaccatggcctgcggctcggcccagatgcttgccgaaacgatcacgggcgccaagccggagctgaatgtggacgactacggtcctgggcgattctga

SEQ ID NO: 830 - protein, 426 aa, Unknown
  Obtained from environmental sample
  SIGNAL (1)...(24)
  DOMAIN (8)...(408): FAD dependent oxidoreductase
MNKRTPERVVVIGGGVVGASTALALAERGLQVTLIERNAELAEETSFANGGGVTPLHSEPWNAPGLLSKVVRNLGRADAPYRLSPLAVPGMGFWGLGFLRHMRPERYRANARRNIDLALYSLACLRQWRERHSLEYRQITAGSMQVYFSRELMAESVQLRRELLKDRATIETLDADQAVTREPALAGVRQRLVGAIYFPDHESGDACQFSREAAARAEGLGARIHCETRVHSFRIEGGQFRAVVTDQGEFEADACVIAAGPESPTLARQVGLRLPIYPVRGYSATFRIDSTEALPTLPMLDTSSRFVTVRLGENGFRVAGLADFAGRRRVIIPRRVESLLAGARRLLPGLAAELVSERAELWAGMRPVTPDGVPLIGPTRKPGVFLNTGHGPMGWTMACGSAQMLAETITGAKPELNVDDYGPGRF

SEQ ID NO: 831 - DNA, 1137 bp, Unknown
  Obtained from environmental sample
atgtacagcgaaacgaagacgacgagaaacgtggactgcatcgtgatcggggccggcatggcgggcgcctcggcggcggcctcgctgtcggccgaggccgaggtcgtgatcctcgaagcggaggcgcaggccggctaccactccaccggccgctccgccgcgctgtactcggcgttgtacggcaatgcgccggtgcgggcgctgacgcgggcgagcctcggcttcttccgcgagccgcgcgagcagccctacctgcgggaccgcgacaccctgttcctgatcggtgccggccagcaggcggacgccgaggccttcgctgtcgatgccgacatccgcgagcagaccgtcgcgctcagcgccgacgaggcgatggcccgcgtgcccatcctgcagcgcgagcgcgtggccggtgcgctgctggacaccggttcggccgatatcgaggtggacctggtgcaccagggcttcctgcgccaggcccgggccaacggggtggcgctgcatctgggcgcgccgctgctcgatctcggccgcgacgggggcacctggatcgcgcacaccgcgcgcggcagcttctgcgccccggtcgtcgtcaatgcagccggcgcctgggccgacgccgttgcctcgctggccggcatcgcgccgctgggcctgcagccgctgcgccgcacggccgtgctgatcgacgtgcccgaggggctcgacgcatcggcctggccggccgtcatcgccgtcgacgagagccagtacttcaagcccgacgccggcctgctgctgatctccgctgccgacgagacgcccagcctgccttgcgacgcgcagccggacgaaatggacgtggccatcgccgtcgaccgcttcgagacgctgaccggccgcgccgtgcggagcctgcgccaccagtgggcaggactgcgcgtgttcagccccgaccgcacgccggtgctcggcttcgagcccgaggcgccgggcttcttctggtgcgccggccagggcggctacggcatccagacctcgccggcgatgggccgagccgccgccgcgctggcgctcggcgcgccgctgcccgacgacctgctggcgctgggcgtccaggcgcggcacttgtcgcccgcccgtttccgcaacacctga

SEQ ID NO: 832 - protein, 378 aa, Unknown
  Obtained from environmental sample
  DOMAIN (12)...(350): FAD dependent oxidoreductase
MYSETKTTRNVDCIVIGAGMAGASAAASLSAEAEVVILEAEAQAGYHSTGRSAALYSALYGNAPVRALTRASLGFFREPREQPYLRDRDTLFLIGAGQQADAEAFAVDADIREQTVALSADEAMARVPILQRERVAGALLDTGSADIEVDLVHQGFLRQARANGVALHLGAPLLDLGRDGGTWIAHTARGSFCAPVVVNAAGAWADAVASLAGIAPLGLQPLRRTAVLIDVPEGLDASAWPAVIAVDESQYFKPDAGLLLISAADETPSLPCDAQPDEMDVAIAVDRFETLTGRAVRSLRHQWAGLRVFSPDRTPVLGFEPEAPGFFWCAGQGGYGIQTSPAMGRAAAALALGAPLPDDLLALGVQARHLSPARFRNT

SEQ ID NO: 833 - DNA, 1257 bp, Unknown
  Obtained from environmental sample
atgcatgtcatcgtgattggcgccggggtggtgggctcgaccaccgcactggccctggctgaacgcggacttgaagtcacgttgatcgagcgccacggcgaaccgggtgccgagaccagtcatgccaacggtggtggcatcacaccgggccatgccgaaccgtggaattcgccaggcattatccgtcgcctgctgacccgctccggcgagggcgagccgtttcgtatccggcctggagccctgccgggactgtccggctggggcctgcgctttctggccaattcgcgtcccggccgctactacttcaatgcgcgggccaacacccgcctggcggtatattccggtcactgtttgaaagccctgcgcgagcgatacgagctgaactatcaccagtacaccgatggttcgctggagctttacttcagccaggccgaactggaccacgccctggagttgcgtcgccgaatcggtgatccgggtgtggagattcacctgcttggcgttcgcgaagccgtggcgctggagccggcgctggagccgatcgccgcccgactggtcggggccatgcaattgccactgcacgaatccggcgatgcctgcgagttttccgccgaaatggtgcgttgcgcccgcagtctgggcgcgcgcgtcctgttcgataccgaagtggtcaccatcaaccggaacaacgaccggatcagtggggtgcagacggacaaggaaaccatcaacaccgatgcggtcgtgctgtcagccggttgcgccagcccgagcctggcccggccgctgggcttgcgactgccgatctatccggtcaagggctactcggccaccctcgaactcgaccaggttgaactggccccgaccatgccgctgctggatctggagcaacgcattgtcaccgcccgctatggccgacgattgcgcatggccgggctggcagatttcgagggccatgaccgaagtgttcgtcccgaacgaattgcccgcctgctcgaatcggcggccaccctgctgccggcactggccgatgaaattcactccggaaaggccgaaccctgggcgggacttcgccccatgacccccacgggcccaccgatgctcggcccgacccggattcccggactgtatctgaacaccggtcatggctccatgggttggacccaggcggccggctcggccgaagtcctggccgatctggtgaccggaaaaacgccggtgatcgacatgagggggttggaggcggtaaaaggttga

SEQ ID NO: 834 - protein, 418 aa, Unknown
  Obtained from environmental sample
  SIGNAL (1)...(18)
  DOMAIN (2)...(400): FAD dependent oxidoreductase
MHVIVIGAGVVGSTTALALAERGLEVTLIERHGEPGAETSHANGGGITPGHAEPWNSPGIIRRLLTRSGEGEPFRIRPGALPGLSGWGLRFLANSRPGRYYFNARANTRLAVYSGHCLKALRERYELNYHQYTDGSLELYFSQAELDHALELRRRIGDPGVEIHLLGVREAVALEPALEPIAARLVGAMQLPLHESGDACEFSAEMVRCARSLGARVLFDTEVVTINRNNDRISGVQTDKETINTDAVVLSAGCASPSLARPLGLRLPIYPVKGYSATLELDQVELAPTMPLLDLEQRIVTARYGRRLRMAGLADFEGHDRSVRPERIARLLESAATLLPALADEIHSGKAEPWAGLRPMTPTGPPMLGPTRIPGLYLNTGHGSMGWTQAAGSAEVLADLVTGKTPVIDMRGLEAVKG

SEQ ID NO: 835 - DNA, 1395 bp, Unknown
  Obtained from environmental sample
atgctgcgccaactcaccgacttgctgggccgcgagggcgtgctcggaccggacgatgacattgcccgttatgtcagcgagccgcgcgggcgttttcatggccgccccctggccgtggctcgtccccatagcaccgatcaactggcccggctggtgaagttctgcagcgacaagcgcctgcccatggtgacccagggcggcaacaccggactggtcggcggcggatcggcttcggttgacgaaaccgaagtgatcatttgccttgaacgcttgaaccggattcgccggatcgatccggaagatgccggcctggtcgccgaggccggatgcacgctggccgcagtgcgcgaagcagccgaggaccacgccatgctctacccggtcagcctggcctcggagggcacggccaccattggcgggaccatcgccaccaatgccggcggcaacctgaccattcgctacggcaacacccgcagccaggtgctgggtctggaagtggtgctggccgatggccgcgtgtattcggaactggcgccgcttcgcaaggacaacagcggttacgacatcaagcagttgttcatcggctccgaaggcacgctgggcatcatcagtgcggccacattggcgcttgccgcccgaccggcccaaagctggaccgcacttgtggccaccgcctcgctcaagtccggactcgagttgttgaaacgattgcgaaaacatatgggcgagaccctgtcggcctgtgaattcatgccgcgcctggccatggagttcgtgctcgagtacctgggttcggcccgcgatcccttcaatgggccgcatccctggtatgtgctggtccaagtcgacagcgccatggatggagactggctggagacgcgcttgctggacatgctgcaggacaccctgtctgaaaaaatcatcagcgatgtcgtggtcgctgacagcatggccaaagccggtcagctttggcggctgcgtgaatcgatctcgcccgcccaacaaacaggtggcgccagtctgaaacacgatatttccgtaccggtgtcaagcattccggccttcgtcgaccaggccagcagtgatctggccaaggcggttccggggattcgaccgtgcatcttcggccacctcggcgacggcaacctgcacttcaacctcagccagcccgaggccatgcaagccgatcaattccgcgcactggaaagtcgctgcaaccgcatcgtgttcgaccttgtccgacaattcaacggctccatcgccgccgaacacggcattggccaattgcgtcgcgaagaattggccaccggccagccactgaaggtcgacctgatgcgcgccctgaagaagtcactggacccgcacggcctgctcaaccccggaaaggtcgtctga

SEQ ID NO: 836 - protein, 464 aa, Unknown
  Obtained from environmental sample
  DOMAIN (36)...(177): FAD binding domain
  DOMAIN (213)...(463): FAD linked oxidases, C-terminal domain
  SITE (151)...(154): N-glycosylation site. Prosite id = PS00001
  SITE (391)...(394): N-glycosylation site. Prosite id = PS00001
  SITE (423)...(426): N-glycosylation site. Prosite id = PS00001
MLRQLTDLLGREGVLGPDDDIARYVSEPRGRFHGRPLAVARPHSTDQLARLVKFCSDKRLPMVTQGGNTGLVGGGSASVDETEVIICLERLNRIRRIDPEDAGLVAEAGCTLAAVREAAEDHAMLYPVSLASEGTATIGGTIATNAGGNLTIRYGNTRSQVLGLEVVLADGRVYSELAPLRKDNSGYDIKQLFIGSEGTLGIISAATLALAARPAQSWTALVATASLKSGLELLKRLRKHMGETLSACEFMPRLAMEFVLEYLGSARDPFNGPHPWYVLVQVDSAMDGDWLETRLLDMLQDTLSEKIISDVVVADSMAKAGQLWRLRESISPAQQTGGASLKHDISVPVSSIPAFVDQASSDLAKAVPGIRPCIFGHLGDGNLHFNLSQPEAMQADQFRALESRCNRIVFDLVRQFNGSIAAEHGIGQLRREELATGQPLKVDLMRALKKSLDPHGLLNPGKVV

SEQ ID NO: 837 - DNA, 942 bp, Unknown
  Obtained from environmental sample
atgggaacaaacataggcgtagtcggaggtggcatcattggattgtcgactgcgcatcttttggcagatcagggtcataatgtcactatctataccaaggatcaacctgagcacactacatccatgaaagctgctgccatctggtttccatttaaagcagcgccgttagacaaagtcctggaatggagtgctcaatcacttgagcattatcaaataattgccgaatcaccgggctgtggtgtaaagtgggtcgaactatgggtgatggataccccggaacaagctcgatcctggattgaagctgtgcctaaggccgcataccaaatcatcacccgggaagaccttccgccagggtacgctcatggctacctcgtacaggtgccaatgattgacacctcgctattcttaccttttctctacaaccaatttcaaaataagggtaagataatttttaggaagatagcccatctggaagatttgatcccaactcatgaagtagtaatcaattgtaccggactggaagcaaatcagttaacacctgatgaaaaactattcccaatcagaggtcagatcgtaaaattattcgcacagccgggaattcgctatatggctgatgatcatgggcctaatgcattatcctacatcataccccgttccgatggcatcgtattaggaggcacggctcaactacattccgatgatttagaggttgatcacagagaaagtgaacagatattaattcgttgcagtgcactcgaaccaaacttgatcctaaatgtaaaagaatcgatagtcggtctgcggccgggaagggagactgttcgcctggagaaagagccggatctaaatataatccataactatggccatggcggatcaggctatactgtctgctggggttgtgctatggaggttgccagactcgttgctgaagtagtttga

SEQ ID NO: 838 - protein, 313 aa, Unknown
  Obtained from environmental sample
  DOMAIN (4)...(308): FAD dependent oxidoreductase
  SITE (27)...(30): N-glycosylation site. Prosite id = PS00001
  SITE (171)...(174): N-glycosylation site. Prosite id = PS00001
  SITE (288)...(306): D-amino acid oxidases signature. Prosite id = PS00677
MGTNIGVVGGGIIGLSTAHLLADQGHNVTIYTKDQPEHTTSMKAAAIWFPFKAAPLDKVLEWSAQSLEHYQIIAESPGCGVKWVELWVMDTPEQARSWIEAVPKAAYQIITREDLPPGYAHGYLVQVPMIDTSLFLPFLYNQFQNKGKIIFRKIAHLEDLIPTHEVVINCTGLEANQLTPDEKLFPIRGQIVKLFAQPGIRYMADDHGPNALSYIIPRSDGIVLGGTAQLHSDDLEVDHRESEQILIRCSALEPNLILNVKESIVGLRPGRETVRLEKEPDLNIIHNYGHGGSGYTVCWGCAMEVARLVAEVV

SEQ ID NO: 839 - DNA, 1242 bp, Unknown; identical to SEQ ID NO: 809
  Obtained from environmental sample

SEQ ID NO: 840 - protein, 413 aa, Unknown; identical to SEQ ID NO: 810
  Obtained from environmental sample
  DOMAIN (4)...(394): FAD dependent oxidoreductase
  SITE (72)...(75): N-glycosylation site. Prosite id = PS00001

SEQ ID NO: 841 - DNA, 1269 bp, Unknown
  Obtained from environmental sample
ttgaagatcgccgtgctgggcgccggtgtggtgggcgtcaccacggcgtggcacctcgcggcggacggtcatgacgtggtcgtcgtcgaccgcgcgcacgcgccggcgctggagacgagctttgccaacggcgggcagatctccgcgtcgcagaccgagccgtgggcgaatccgggggcgccggggctggtgctgcgctggctcggtcgcgaggacgcaccgctgctcttccgcctgcgcgccgatcccgcgctcttcgcctggggtctgcgcttcctgctcgaatgcctccccggccgcacgcggcgcaatacgctggacgtgctcgcgctcggactctacagccgcgaggcattgcgcacgctgcgttccgcactggcgctcgactacgatcagcagacgcgcggcattctgaagcttttcgaagacgaggccgcgctggcggaagctgccgagcatgcgcacgtgctgtcggcgcgcggctgccgggtcgacgttctgacgcgcgagcagtgccttgcggtcgagcccgcgctcgcgcacgcgcaggtggcgatcgcgggcgccacgcatgcgcgggacgacgaatcgggagatgcctgcaagttcacgacggctctcgcgcagcactgccgggagcgcggcgtcgagtttcgcttcggcacggagattcaggcgctgcgctgcgaagcgaatgtcgtgcgctcgctcgtcgtcagggaacgcggcgggcacacgggagaattcggtgccgacgccttcgtggtgtgcctgggcagttacagcccgcttctcctgcgcagcgcgggcatcgccatcccggtgtatccggtgaagggttattcggtgaccgtcctgatcgaggaccccgctgcggcgcccaccgcgagcatcaccgacgaggcgcgcaagatcgtcttctcacgcctgggtgaccggctgcgcgtggccggcacggcggagatggcggggtacgacacgtcgctcaaccgcgtgcgctgcgaggccattcgcgagcgcgcgcgtcagtggttccccgcggcgagccgttacgatcgagtcgagtactgggcgggcctgcggccggcgacgccgggcaacgtgcctctcatcggccgcacgcggatcgcgaacctcttcgtcaacaccggacacggcacgctcggctggacgctctcgtgcggatccgcacaggcgctggcggacatcgttgcgggtcggcgcccgctgctggatttcccgttcctgggagccgggcgcacggcgtga

SEQ ID NO: 842 - protein, 422 aa, Unknown
  Obtained from environmental sample
  DOMAIN (2)...(403): FAD dependent oxidoreductase
MKIAVLGAGVVGVTTAWHLAADGHDVVVVDRAHAPALETSFANGGQISASQTEPWANPGAPGLVLRWLGREDAPLLFRLRADPALFAWGLRFLLECLPGRTRRNTLDVLALGLYSREALRTLRSALALDYDQQTRGILKLFEDEAALAEAAEHAHVLSARGCRVDVLTREQCLAVEPALAHAQVAIAGATHARDDESGDACKFTTALAQHCRERGVEFRFGTEIQALRCEANVVRSLVVRERGGHTGEFGADAFVVCLGSYSPLLLRSAGIAIPVYPVKGYSVTVLIEDPAAAPTASITDEARKIVFSRLGDRLRVAGTAEMAGYDTSLNRVRCEAIRERARQWFPAASRYDRVEYWAGLRPATPGNVPLIGRTRIANLFVNTGHGTLGWTLSCGSAQALADIVAGRRPLLDFPFLGAGRTA

SEQ ID NO: 843 - DNA, 1290 bp, Unknown
  Obtained from environmental sample
atgcgcgtagttatcttgggcagcggcgttatcggcgtcaccagtgcctactacctggccaaagccggccacgaagtgacggtgctggaccgcgaagccgcaccggccatgggcaccagccacgccaacgccggccagatctcgcccggctacgcctcgccctgggccgcgcccggcattccgttcaaggccatgaagtggatgctgcagcgccacgcgcccctgtcgatcaccccggacggcaccctgttccagctgaagtggatgtggcagatgctgcagaactgcaccgccgagcgctacgccgtcaacaaggaacgcatggtgcgcctggccgaatactcgcgcgactgcatcaaggccctgcgcgccgaaaccggcatcgaatacgaaggccgccagctcggcaccacccagctgttccgcacccaggcgcagctggacgccgccgccaaggacatccaggtgctggaggaaaccggcgtgccgtatgagctgctgacccgcgagcagctggtcggcgccgaaccgggcctggccggctcgctggaccgcctgaccggcggcctgcgcctgcccaacgacgaaaccggcgactgcctgctgttcaccacccgcctggccaagatggcgcaggacctgggcgtcaaattccgctacggcgtcgacatcaccggcctggtcaccgagggcgacaccatccagggcgtgcactgcggcgatgaactggtcaaggccgactcctacgtggtggcgctgggcgtgcattcgaccccgctgctgaaaggcctggtcgacattccggtctacccgctcaagggctactcgatcaccgtgccgatcgtgaacgccgacgcggccccgacctcgaccatcctggacgagacttacaagatcgcagtgacccgcttcgacgaccgcatccgcgtgggcggcatggcggaaatcgccggctacaaccgcaagctgaatccgcgccgccgcgagaccctggagatggtggtcaacgacctgttccccggcgccggcgacaccgcggcggccactttctggaccggcctgcgtccgatgaccccggacggcaccccgatcgtcggccgcaccggcgtgcgcaacctgttcgtcaacaccggccacggcaccctgggctggaccatgtgctgcggctcggcccagctgctgtcggacatcatctcggcgcgccgtcccgccatcctggccgacgacctgtcggtggcgcgctacagccgtccggacgccgtgcgccgtccgcagctggtcaacgcgtaa

SEQ ID NO: 844 - protein, 429 aa, Unknown
  Obtained from environmental sample
  DOMAIN (2)...(397): FAD dependent oxidoreductase
  SITE (96)...(99): N-glycosylation site. Prosite id = PS00001
MRVVILGSGVIGVTSAYYLAKAGHEVTVLDREAAPAMGTSHANAGQISPGYASPWAAPGIPFKAMKWMLQRHAPLSITPDGTLFQLKWMWQMLQNCTAERYAVNKERMVRLAEYSRDCIKALRAETGIEYEGRQLGTTQLFRTQAQLDAAAKDIQVLEETGVPYELLTREQLVGAEPGLAGSLDRLTGGLRLPNDETGDCLLFTTRLAKMAQDLGVKFRYGVDITGLVTEGDTIQGVHCGDELVKADSYVVALGVHSTPLLKGLVDIPVYPLKGYSITVPIVNADAAPTSTILDETYKIAVTRFDDRIRVGGMAEIAGYNRKLNPRRRETLEMVVNDLFPGAGDTAAATFWTGLRPMTPDGTPIVGRTGVRNLFVNTGHGTLGWTMCCGSAQLLSDIISARRPAILADDLSVARYSRPDAVRRPQLVNA

SEQ ID NO: 845 - DNA, 1233 bp, Unknown
  Obtained from environmental sample
atgcaaagcgcgatcgtactcggcggcggcatgatcggcgtaagcgccgcgctgcacctcaagcagcgcggctggtcggtcaccctcgtcgatcgcagggagcctggccgcgagaccagctacggcaatgccggcatgatccaggccgaagcggtgcgcccctatccgatgccgcgcgacctcgcctcgctcctgaagatcgcgaccggccgcaccaacgacgtgcgctacagcttctcgtcgcttcatcgccatatcgagccgctgctgcgctattggtggcattcggcgccgaagcggcatcgtgaggcgatcgtcggctgggcgcgcctgatcgcctatgcgacgcccgagcacgacatcctcattcgcgaagcccatgccgacaatctgatccgccgcgccggctatcgcgcgctgtatcgtgaccgcgccgcgctggacctctcgatcaaggccgcggaggaggacaagcgcgagttcggcgtgaattttcgcgtgctgtcaggcagcgagctgacaaaggccgagccgatcctgcgcgacgatctccccggcgcgatccattggctcgacacctggacggtgtccgatccgggcgcgctggtcaccgcctatgccgagctgttccagcgccttggcggcacgatcgtgctcggtgatgcgcagtcgctgcaacagaccgcgaccggctggtccgtcgatactgaccagggccgcatcgatgccgcccacgccgtcgtcacgctcggaccgtggtcgccggatctgctctacaagttcggctatcgcatcccgctggtgcgcaagcgcggctatcacatgcattacagcggcggcgcgtcgctcgatctgccgctggtcgacaagggcaacggctacgccatgggcccgatggccaagggcatccgcatcaccaccggcgccgagctgaccggaccggacgcgctcgcaacaccgatccagctcgccagcgccgaggcctccgcacgcgagctgatcgatctcggcaagcgcgccgagcccgacccgtggttcggcacccgcccctgcacgcccgacatgctgcccgtgctcggccgcgccccgcgccaccccggcctctggatgaactttggtcacggccaccaaggctttacgctgggacccgcgacggggcgcctgctcgcggagatgatgaacggcgaaacgccgtcgatcgatccgaccccgtaccggccggagcggttttaa

SEQ ID NO: 846 - protein, 410 aa, Unknown
  Obtained from environmental sample
  DOMAIN (3)...(392): FAD dependent oxidoreductase
MQSAIVLGGGMIGVSAALHLKQRGWSVTLVDRREPGRETSYGNAGMIQAEAVRPYPMPRDLASLLKIATGRTNDVRYSFSSLHRHIEPLLRYWWHSAPKRHREAIVGWARLIAYATPEHDILIREAHADNLIRRAGYRALYRDRAALDLSIKAAEEDKREFGVNFRVLSGSELTKAEPILRDDLPGAIHWLDTWTVSDPGALVTAYAELFQRLGGTIVLGDAQSLQQTATGWSVDTDQGRIDAAHAVVTLGPWSPDLLYKFGYRIPLVRKRGYHMHYSGGASLDLPLVDKGNGYAMGPMAKGIRITTGAELTGPDALATPIQLASAEASARELIDLGKRAEPDPWFGTRPCTPDMLPVLGRAPRHPGLWMNFGHGHQGFTLGPATGRLLAEMMNGETPSIDPTPYRPERF

SEQ ID NO: 847 - DNA, 1131 bp, Unknown
  Obtained from environmental sample
atgcaacaggccgactacatcatcatcggcgccggcattgccggcgcgtccaccggctactggctggcgccccacggcaaggtcctgctgctggagcgcgaaaccctgccgggctatcactccaccggtcgctcggcggcgctctacaccgctgcctacggcacgccgcaggtacgcgccctgaccctcgccagccgggccttcttcgaccagccgcccgctggcttcgccgaccacccgctactgaccccgcgcggcgagatgaccgtggacttcgaaggcgatgccgaagaactccagcgccagttcgaaagcgcccgcacctgcgtgccggacatgcagttgctcgacgccgatgaagcctgcgcgcggattccggtgctcaagcgggaaaaggtccacggtgccctgtacgaccccagcgccagcgatatcgataccgacggcctgcaccagggctacttgcgcggcatccgtcgccagcagggcgagatccatggcgattgcgaggtgctgggcctggacaaggatgcgcagggtcagtggctcgtcgaaacctcacgcggtaagttccgcgccccggtgctgatcaatgccgccggaggctgggccgacaggatcggtgagctggccggggccaggccgctgggcctgcaacccaagcgccgcgccgcgttcatcttcgaagcgccggcaggcatcgacacccacgcctggccgatgctggtcagcctggacgagtcgttctacatgaagcccgacgccggcatgctcctgggttcgccgtgcaacgccgacccggtcgagccccacgatgtacagccggaagagctggacatcgccctgggcatctaccagatcgaggaagccaccaccctgacgatccgccgccccttccgcacctgggccgggctgcgcagcttcgttgccgacggtgacctggtggccggcttcgatcccttggtgagcggcctgttctgggtcgccgcacaaggtggctatggcatccagacctcgccggccatgggccaggccagcgccgcgctggtgcgtggggaagaattgccggccgaattgcgtggcttcggcctgagcgccgcacaactgtcacccgcgcgcctcggcgggtga

SEQ ID NO: 848 - protein, 376 aa, Unknown
  Obtained from environmental sample
  DOMAIN (5)...(349): FAD dependent oxidoreductase
MQQADYIIIGAGIAGASTGYWLAPHGKVLLLERETLPGYHSTGRSAALYTAAYGTPQVRALTLASRAFFDQPPAGFADHPLLTPRGEMTVDFEGDAEELQRQFESARTCVPDMQLLDADEACARIPVLKREKVHGALYDPSASDIDTDGLHQGYLRGIRRQQGEIHGDCEVLGLDKDAQGQWLVETSRGKFRAPVLINAAGGWADRIGELAGARPLGLQPKRRAAFIFEAPAGIDTHAWPMLVSLDESFYMKPDAGMLLGSPCNADPVEPHDVQPEELDIALGIYQIEEATTLTIRRPFRTWAGLRSFVADGDLVAGFDPLVSGLFWVAAQGGYGIQTSPAMGQASAALVRGEELPAELRGFGLSAAQLSPARLGG

SEQ ID NO: 849 - DNA, 1269 bp, Unknown
  Obtained from environmental sample
gtgagggtcctcgttctgggcgcgggtgtggtgggtacggccacggccctggcgctggcccggcgcggcctggatgtgaccctgatcgagcgcgaggaggagcccgcccgcggcaccagccacgccaatggcggcggcatcaccccggcccacgccgaaccctggaacgcgccgggcatcggctggatgctgctgcgctggctgggccgacgcgacgcgccgttccggctgagaccctcggcgatcccgggcatgacgcgctgggggctggcctttctggcccactccaggcgcaggcgcttcatcgaaaacgcccgcgcaagcatccgcctggcggtgtattcgggacaacggctgaaggcctggcgcgatgaactggagctggaatacgggcagcgcacgctgggctcgatcaaggtcttctggacccgtcgcgagctggataagtccctgaaactgctgaccggcgtcggccatccagaggtggcctggaaggcgttgtcgccggccgaggcggtggagctcgagcccgccctgggcccggttgccgaaaggctggccggcacgctgcactttcccggcaacgagtcgggcgacgcccgccggttcagcctggccgcggccgagaaggcgcgcgagctcggcacgcggttgcagttttcaaccgccgtggagtccatcgaatgcgacgcctggggtttccggagcgtgcgcacgagccagggtgatttcgaggccgaggcctgcatcgtgtgcctgggctgcgacagtccggcgctgctcaacccgctgggcgtgcgcgtgccgatctacccggtcaagggctactcggccacccttgagcttgacgatcccgccgccgcgccggctggctgcgtgctcgacgcgggccaccgggtgatcgtcacccggctgggcgagaaggtgctgcgagtggccgggaccgccgagttcgccggccacgacctggaaatcgaccgggtacgggcccgctcgatgctcgacagcgcactggcggtgtttccggcgctgggccgggaaatcgagggacgcgagcccgagttctggaccgggctgcgccccatgaccccggatgggccgccgctgctcggccgcgccggcccgcgcggggtctggctgaacaccggccacggctccatgggctggacccaggcggccggctcggccgagatcctggccgacctgatcaccggaaagtcgccggccatcgacgtgtccgggctcgaagcagcgcgctggaaccagtaa

SEQ ID NO: 850 - protein, 422 aa, Unknown
  Obtained from environmental sample
  SIGNAL (1)...(18)
  DOMAIN (2)...(402): FAD dependent oxidoreductase
MRVLVLGAGVVGTATALALARRGLDVTLIEREEEPARGTSHANGGGITPAHAEPWNAPGIGWMLLRWLGRRDAPFRLRPSAIPGMTRWGLAFLAHSRRRRFIENARASIRLAVYSGQRLKAWRDELELEYGQRTLGSIKVFWTRRELDKSLKLLTGVGHPEVAWKALSPAEAVELEPALGPVAERLAGTLHFPGNESGDARRFSLAAAEKARELGTRLQFSTAVESIECDAWGFRSVRTSQGDFEAEACIVCLGCDSPALLNPLGVRVPIYPVKGYSATLELDDPAAAPAGCVLDAGHRVIVTRLGEKVLRVAGTAEFAGHDLEIDRVRARSMLDSALAVFPALGREIEGREPEFWTGLRPMTPDGPPLLGRAGPRGVWLNTGHGSMGWTQAAGSAEILADLITGKSPAIDVSGLEAARWNQ

SEQ ID NO: 851 - DNA, 975 bp, Unknown
  Obtained from environmental sample
gtgtgttccgaggagcgagctatgaccccaaccgtggccgtcgtcggggccggtgtgatcggtctcagttgtgcgctcgagttggctcgaaccggcgcacacgtcaccgtgtacgccgatagttccgccgatggaaccggcacaacatcggtgatcgctggtgcgatctggtttccctacctcgcacagcccagagaagctgtgagccgatggtcggccgagaccctcaccaaactctcggagctcgccgccacccccgacacgggtgtgctcctgcggcgtggccgagtgctgctgcgccgccgcgacacggacctcgcctggacagcgtcgatcaacgactaccgcaccctcgaccaggggcttcccagcggtgtgctctcggcgatcgagtgcaccctccccgtggtgaacatggcggtctacctcggttggctcacagcagagtgtcgagcgtggggcgtgccaattgtgcgccgccgcgtgacgagtctgtcagagatcgatgatcgattcaccacggttgtcgtcgccaccggtttacgctccgccgagttgcttgaagaggatcgtctctacccggttcggggccaggtggtgcggctgcggaacccgggaatcaccgactggctcatcgacgacgacaatccggcaggcatcacctacgtctttccgcgcggtgacgacgtggtgtgtgggggaacagccctgatcggtgataacagcacggcggtgaacccggaggtcgaagcgcgcattctcgagcgggctcgagcgctggtaccggctctgcggaacgagcccgtggtgagccgagccactggcctgcgacccgctcgcgacgccgtgcggctcgagcgggtggccggcgccgaccgcgacgttatcgcctgctacggccacggcggtgcaggggtcaccctgtcatggggctgcgccgcagaagtcgcctccctggtggcgatgggatcgtga

SEQ ID NO: 852 - protein, 324 aa, Unknown
  Obtained from environmental sample
  DOMAIN (11)...(319): FAD dependent oxidoreductase
  SITE (244)...(247): N-glycosylation site. Prosite id = PS00001
MCSEERAMTPTVAVVGAGVIGLSCALELARTGAHVTVYADSSADGTGTTSVIAGAIWFPYLAQPREAVSRWSAETLTKLSELAATPDTGVLLRRGRVLLRRRDTDLAWTASINDYRTLDQGLPSGVLSAIECTLPVVNMAVYLGWLTAECRAWGVPIVRRRVTSLSEIDDRFTTVVVATGLRSAELLEEDRLYPVRGQVVRLRNPGITDWLIDDDNPAGITYVFPRGDDVVCGGTALIGDNSTAVNPEVEARILERARALVPALRNEPVVSRATGLRPARDAVRLERVAGADRDVIACYGHGGAGVTLSWGCAAEVASLVAMGS

SEQ ID NO: 853 - DNA, 1131 bp, Unknown; identical to SEQ ID NO: 847
  Obtained from environmental sample

SEQ ID NO: 854 - protein, 376 aa, Unknown; identical to SEQ ID NO: 848
  Obtained from environmental sample
  DOMAIN (5)...(349): FAD dependent oxidoreductase

SEQ ID NO: 855 - DNA, 1173 bp, Unknown
  Obtained from environmental sample
atgcagaaagatatctgggatttcgtcatcgtgggcgcgggcatggccggagcctccaccgcctggcagctggcgcagtcgggtggcgagaacccgccctcggtgctggtgctggagcgcgaatcccagcccggctatcacaccaccggccgctcggcagcgctgtttgaagagcattacggtcccgcccaggttcaggccctgacccgcgccagccgcgccttctacgatgcgccaccggccggttttgccgaagcccccatcctcacgccgcgcggcgtgctctatgtgggcacggccgatcagcgggatctggtggatgctgcctacgccgaggcccaggttcactcccccgatgcccagcgcctgagcgccgcacagctcaagaccctggttcccgtgctcgacaccgaggtgctggtggacggctttctcgataccggtgcgcgtgacatcgatgtgcacggcctgcaccagggctatatccgcggcctgcgccagcgcggcggcgacctgtggtgcaacgccgaggtccaggccatcacccgggtcaatgacttctggcacattgccctgccccagggccggagccttcgttccaaggtaatcgtcaacgccgccggagcctgggtggatgtcgtggccgccatggtcggagcggctcccattggcatcaccccaaaacgccgcagcgccttcaccttccctgtccccgaaggcttggacgccacgctctggcccgccatcatcagcgccgatgaaaactggtacatcaagcccgacgccggccagctgctgggctcccccgccaatgcagatcccgtggcaccgcacgatgtcgtgcccgaagagctggacattgccatcggcatccatcacatcgaggaagccaccacgctgcaaatccgccgcccctcgcatacctgggccggcctgcgcagctttgtcgccgatggcgagctggtgatcggctgggatgcctcgcccacgcccgtgccgggctttttctgggtcgccgcccaaggcggctatggcatccagagcgccgccggctacagcctgctggcgcgcaatctgctgctcggggaaacgctggatgcggcgctggccgcacagaaggtgaatgtgggggcagtgtcgcctgcgcgttgtcagctggcgactcagaattga

SEQ ID NO: 856 - protein, 390 aa, Unknown
  Obtained from environmental sample
  DOMAIN (7)...(359): FAD dependent oxidoreductase
MQKDIWDFVIVGAGMAGASTAWQLAQSGGENPPSVLVLERESQPGYHTTGRSAALFEEHYGPAQVQALTRASRAFYDAPPAGFAEAPILTPRGVLYVGTADQRDLVDAAYAEAQVHSPDAQRLSAAQLKTLVPVLDTEVLVDGFLDTGARDIDVHGLHQGYIRGLRQRGGDLWCNAEVQAITRVNDFWHIALPQGRSLRSKVIVNAAGAWVDVVAAMVGAAPIGITPKRRSAFTFPVPEGLDATLWPAIISADENWYIKPDAGQLLGSPANADPVAPHDVVPEELDIAIGIHHIEEATTLQIRRPSHTWAGLRSFVADGELVIGWDASPTPVPGFFWVAAQGGYGIQSAAGYSLLARNLLLGETLDAALAAQKVNVGAVSPARCQLATQN

SEQ ID NO: 857 - DNA, 1173 bp, Unknown; identical to SEQ ID NO: 855
  Obtained from environmental sample

SEQ ID NO: 858 - protein, 390 aa, Unknown; identical to SEQ ID NO: 856
  Obtained from environmental sample
  DOMAIN (7)...(359): FAD dependent oxidoreductase

SEQ ID NO: 859 - DNA, 1173 bp, Unknown; identical to SEQ ID NO: 855
  Obtained from environmental sample

SEQ ID NO: 860 - protein, 390 aa, Unknown; identical to SEQ ID NO: 856
  Obtained from environmental sample
  DOMAIN (7)...(359): FAD dependent oxidoreductase

SEQ ID NO: 861 - DNA, 987 bp, Unknown
  Obtained from environmental sample
atggcgcattatgacgcggttgtggtcggcgccggtgttgtcgggctgaccaccgccgtctcgctcgccgaggcaggcctgagcacccgggttgtcaccgccgctttgccgtcggacaccacctcggtggcggcgggcgcgatctgggggccggtgctgtgcgggccgccgaaccgcgcttacgagtggtcgcgcaccggcctgtcggtgctctcggagctggcggacgagcccgcggcggcgatccgccaggtcagcggggtggaggtcgctacgtccccggtgccgccgcccggctggacggacctgctgcctgacctgcggctgctcggcgccgatgagctcccgtccggcttcgcctgcggctggcgctacaccgcgcccgtggtcaccatgccgctgtacctggagtacctgcggcagcggttcgaggccgcgggcggttcggtcgagatcgcgcccgtcacgtcgctggccgggctggccgggctgtccggcgctccggtcgtggtgaactgcaccggcgtcggcgcccgggacctggtgcccgaccccgcggtcgtgccggtccgcggccaggtcgtcgtggtgaagaatcccgggatcgacgagttctacatcgaccacacgctgcacggcacggattacatctacgtgttcccgcacggcgacgtggtgctgctcggcggaactgccgaggaaggcgcctgggatatgcccgctcgttcagctatatcagaacggatactggcagactgctcgacgatattcccccgcttgcgcggggcggaggtggtggagcaccgggtcgggctgcgcccgtaccggccgacggtgcggctggaagcggaagctctgcctgccacaccggcggcgagcgggcgggtgctgtggcacaactacgggcacggcggcggcggggtcacgctgtcctggggctgcgcccgcgagatcaccgacgcggtgctcgcgggcgcatgggcatga

SEQ ID NO: 862 - protein, 328 aa, Unknown
  Obtained from environmental sample
  SIGNAL (1)...(23)
  DOMAIN (5)...(321): FAD dependent oxidoreductase
  SITE (174)...(177): N-glycosylation site. Prosite id = PS00001
MAHYDAVVVGAGVVGLTTAVSLAEAGLSTRVVTAALPSDTTSVAAGAIWGPVLCGPPNRAYEWSRTGLSVLSELADEPAAAIRQVSGVEVATSPVPPPGWTDLLPDLRLLGADELPSGFACGWRYTAPVVTMPLYLEYLRQRFEAAGGSVEIAPVTSLAGLAGLSGAPVVVNCTGVGARDLVPDPAVVPVRGQVVVVKNPGIDEFYIDHTLHGTDYIYVFPHGDVVLLGGTAEEGAWDMPARSAISERILADCSTIFPRLRGAEVVEHRVGLRPYRPTVRLEAEALPATPAASGRVLWHNYGHGGGGVTLSWGCAREITDAVLAGAWA

SEQ ID NO: 863 - DNA, 1299 bp, Unknown
  Obtained from environmental sample
atgcgggttctggtgcttggtagcggtgtgatcggtacggccagtgcgtattacctggcccgccagggcttcgaggtggtggtcgttgatcgccaggacggcccggccatggaaaccagcttcgccaacgccggccaggtatcgccgggttatgcctcgccctgggcggcgccgggtatcccgttgaaggcgatgaagtggctgctgctaaagcacgcgccgctggccatcaagctgactggcgatgttgatcagtacctgtggatggcgcagatgctgcgcaactgcaccgccgcccgctacgcggtgaacaaggaacgcatggtgcgcctgtccgagtacagccgtgattgcctcgacgagctgcgcgcggaaaccggcattggctacgaagcacgccagcttggtaccacccagctgttccgcacccaggcgcagctggacaacgccgccaaggatatctcggtgctcgagcaatccggcgtgccctacgagctgctcgatcgcgccggcatcgccaaggtcgaaccggccctggccagcgtcaccgacaaactcgctggcgccctgcgtctgcccaatgaccagaccggtgactgccagctgttcacccgcaaactggccgagatggccaccgcgctgggcgtgcagttccgtttcggcaagaacatccagcgcctggatgtcgccggtgaccgtatcaacggcgtgtggattgacggcaagctggaaaccgccgaccgctacgtactcgccctgggcagctacagcccgcaactgctcaagccgctgggcattcgcgcgccggtctatccgctcaaggggtactcgctgacggtgccgatcaccaacccggacatggcgccgacgtcgaccatcctcgacgaaacctacaaggtcgccatcacccgcttcgaccagcgcatccgtgtgggcggcatggccgaaatcgccggcttcgacctgagcctcaacccacgtcgtcgcgaaactttggaaatgatcgtcggtgatctgtatccccagggcggtgacctgagccaggcggatttctggaccggtttgcgcccggcgacccctgatggcacgcccatcgttggcgccaccccctatcgaaacctgtttctgaacaccggacacggtaccctaggctggaccatggcctgcggctccggtcgcctgctggccgacctgatcgccaggaagcgcccgcagatcagcagcgaaggcctggatatttcccgttacggtagccccaaggagttgaacaagcatgtccatacagcgcctgcgaactga

SEQ ID NO: 864 - protein, 432 aa, Unknown
  Obtained from environmental sample
  DOMAIN (2)...(398): FAD dependent oxidoreductase
  SITE (96)...(99): N-glycosylation site. Prosite id = PS00001
MRVLVLGSGVIGTASAYYLARQGFEVVVVDRQDGPAMETSFANAGQVSPGYASPWAAPGIPLKAMKWLLLKHAPLAIKLTGDVDQYLWMAQMLRNCTAARYAVNKERMVRLSEYSRDCLDELRAETGIGYEARQLGTTQLFRTQAQLDNAAKDISVLEQSGVPYELLDRAGIAKVEPALASVTDKLAGALRLPNDQTGDCQLFTRKLAEMATALGVQFRFGKNIQRLDVAGDRINGVWIDGKLETADRYVLALGSYSPQLLKPLGIRAPVYPLKGYSLTVPITNPDMAPTSTILDETYKVAITRFDQRIRVGGMAEIAGFDLSLNPRRRETLEMIVGDLYPQGGDLSQADFWTGLRPATPDGTPIVGATPYRNLFLNTGHGTLGWTMACGSGRLLADLIARKRPQISSEGLDISRYGSPKELNKHVHTAPAN

SEQ ID NO: 865 - DNA, 861 bp, Unknown
  Obtained from environmental sample
  misc_feature (1)..(861): n is a, c, g, or t
atgaaaatgatcggatattataacggagtgcttggcaatctgcaggaaatgcagattccgatgcaggatcgggcgctgtatttcggagacggcgtctatgatttcactcctgcctacaacggcaaactgtttgccatcgaagaccatctcgaccgttttttccattccatggaaatgctgtcgatccgcccttactgtgatcgggaaactctgaagaaggaactggaacgctgcgtggcggcgacggaaagcacggaaccgatggcggtttactggcagacttcccgcggcaactgccggcgcaatcatatttttccgccggagggaacaccgactacgcttctgatcacggtcacaccattgaaaccgctggatccgaatgtatcactgaagctggcttcgtttgaagacaagcgttttcagtactgcaatatcaagacactgaatctgattcccaatgttctggccgcgcagtacgcggaagagcagggatgtcaggaagctgtgttccaccgcggtaagtttgtaatggaatgcgcccacagttcactcgtcctgctgaaggacggtgtactgatggcaccgccgctcgatgacaggatactgccgtccatcacccgcaaacatatcacggccatctgcaaaacactggatgttccggtcgaggaaagaaagatcacgatggatgaactgtatgaagcggacgaactgatcgttctgagttccagcaagctgattgcccgggccaatgtactggatggcaaaccggtcggcatgagtgactccatgctgttcacgatgatccgagacgcatatttcaggatggtcgaaaaagaaaccggctatcgtatcggagagtag

SEQ ID NO: 866 - protein, 286 aa, Unknown; identical to SEQ ID NO: 54
  Obtained from environmental sample
  DOMAIN (8)...(273): Aminotransferase class IV
  misc_feature (1)..(286): Xaa is any amino acid

SEQ ID NO: 867 - DNA, 1062 bp, Unknown; identical to SEQ ID NO: 31
  Obtained from environmental sample
  misc_feature (1)..(1062): n is a, c, g, or t

SEQ ID NO: 868 - protein, 353 aa, Unknown; identical to SEQ ID NO: 32
  Obtained from environmental sample
  DOMAIN (14)...(347): Aminotransferase class I and II
  misc_feature (1)..(353): Xaa is any amino acid

SEQ ID NO: 869 - DNA, 852 bp, Unknown
  Obtained from environmental sample
  misc_feature (1)..(852): n is a, c, g, or t
atgtattcattatggaatgatcaaatagtgaaggatgaagaagtaaagattgataaagaagaccgaggctatcaatttggagacggcatatacgaagtaattaaagtgtatgacggtgaaatgtttacagctgaggaacatatcgatcgtttttatgaatgtgcagaaaaaattcgattaacaattccatatacgaaacataaacttcatcaattgttacatcaattagtagaagcaaatgagttaaagacaggacatatctatttccaaattacacgtggggttgcgtcacgagtacacaatttcccagcaggcaatgtgcagcctgtattatcagggacgacaaaagaatttccaagacctgtagaaaactttgaaaaaggggtaaaggcaacttttacagaagatattcgttggctacgatgtgatataaaatcactgaacttattaggtgcagtattagcgaaacaagaagcgattgaaaaagggtgttacgaagcaattttacatcgtgatggaatagtaacagaaggctcttcaacaaatgtatttggcatcaaaaatggaactctctatacacatcctgcaaacaatttaattttgcgcggaattacacgcggtgttattttaacttgtgcaaaggaaatagagctaccagtagtagagcaaccatttacgacaaaacaggcgttagaaatggatgaattatttgtttcatcaacaacttctgaaattacgccggttattgagatcgatggtgtcaaaataaataatggtgttattggagaatggacacgtaaattacaaaaacaatttgaaacgaaaattccaacaccttttacgaataaatag

SEQ ID NO: 870 - protein, 283 aa, Unknown; identical to SEQ ID NO: 42
  Obtained from environmental sample
  DOMAIN (6)...(273): Aminotransferase class IV
  misc_feature (1)..(283): Xaa is any amino acid

SEQ ID NO: 871 - DNA, 1350 bp, Unknown
  Obtained from environmental sample
  misc_feature (1)..(1350): n is a, c, g, or t
atggctctcgaacatgcctatcgtcaagcgctcccggcctcacgcgcgctctttgagcgcgcccaacacctcttcccagacggggtcactcacgataaccgccgtatgcagccttttccaatctttgtcgaacgcgccgatggtgcctacaaatgggatgtcgatggtcgacagtacatcgactactggatgggccatggcgccctcattatggggcataaccctccgcacgtgcgtgatgccgtcattgagcaggcggcgcgtggcacgcattacggcgccagccatgctctcgaagtatcatgggccgaatgggtctgcaagctggtgccatgtgctgagcgcgtacgcttcacggcctcgggcactgaggcgacgcatatggccctgcgtctggcccgcgcctatacgggcaagcgcaatgtcatcaaattcgccgggcacttccacggctggcacgagggtctagaagtgggtgtgcaaaccccctatgagatggtgccagagccagggcaaatgcaagaggcggtggacgcagtcgccctgtgccccccgaatgatatcgaggctgtccgggctgccctcgccgctggcgacgtggccgctatcatcctcgaacctacgggtggccactttggcacggtgccggtggcgccagattttttacagcgtctacgcgaagaagccaccagggccggagtcgtactcattttcgacgaggtagtgacaggttttcgcgttgcgccaggcggggctcaggaactctacggggttacgcctgacctctccacgttcgccaaaattctcgctggtggtctaccaggtggggctgtcgctggccgcgccgagatttttcattatctggcgacgcctacaaccactgaggtgggaaagcgtgcgaagattcaccatcctggcacgttcaacgccaaccctctctcggccgcggccggtgtggccatgctgtcgtccctggccgatggtacccccatcaagcgcgccaacgagcaggctgccaagctgcggcacggcatgaacgatatcctggcacgcgaaaaagtcgcctggaaggtctacggccagcacagcgattggaagctgttctatggggctgacgccccaccgcgtgacggcgctgaccagtccgtggatgacatcccctggcagcgtcttgatggcaaattcccacagcagagccgggccatgcggcaggcgctcattttacagggcgtcgattttaacggcgcacgtgctctggtgggtacctgccatactgatgatgtggtcgctgatacgctagcgggctttgcagaggcggtgcgggccgtcaaagctgacgggctcgcgtag

SEQ ID NO: 872 - protein, 449 aa, Unknown; identical to SEQ ID NO: 44
  Obtained from environmental sample
  DOMAIN (42)...(375): Aminotransferase class-III
  misc_feature (1)..(449): Xaa is any amino acid

SEQ ID NO: 873 - DNA, 1401 bp, Unknown
  Obtained from environmental sample
  misc_feature (1)..(1401): n is a, c, g, or t
atgagcaccccgccgaccaatccgccgaccaattcggcgatcatcacggactacaaggcgcggacccaggggtccggtgcgctgtttgagcgcgcccgcaaggtgctgcccagcggcatcacgcacgatgcgcgctatctcgacccgtactcgatccacgtcgccaaggccaagggcgcccgcaagtgggatgtcgatggcaacgagtatgtggactatttcggcggccatggcgccatgctgctcggccattcgcacccggcggtggtcgaggcggtgcagaagcagatggagctcggcacgcactatggctcgagccatgagctggaggtgcgctgggccgagctggtctgcgagctgacgccgtgcgccgagaaggtgcgctttaccgcgtcgggcaccgaggcctcgcacatggcgatccgcctggcgcgcgcctacaccggcaaggacaagatcgtgcgtttcatcggccacttccacggctggcacgacaacgtgacggccggcgccggcgccacctacgacggtggcaccacgccgggcgtgccgcaggacgtgagcgcgctctcgatcgtgatgccgagcgacaacgtcgccgcggtggtgaagctgatcgaggagcgtgacgacatcgccgccgtgatgttcgagccgtcaggcgcctcgtggggccaggcgcccttgccgccgggcttcatccaggcggtgcgcgacgccacgaagaagaagggcgtcatcatgctgatggacgaggtgatcaccggctatcgctggtcgtccggcggcgcgcagaaggcgttcggcatcacgcccgacctctgcatccaggccaagatcgtcgccggcggcctgccgggcggcgcggtcgcgggcaagcgcgacatcctcgaccgcatcgatcacgacgccacggcggcgaagaagatcgagcgtatcctccatcccggcacctacaacgccaatcccttgtccgccgcggcggcggtgacggcgctcacgctggtgcgcgaccaggacctcgccgagaaggccaacaagacggcggccgaattgcgcaaggcgctgaccgaggtgctggtgaaggaaggcgtgccgtggggcatctacggccagagctcgaccttcctgatctatcccaacccgttcaacgatccgatcgatcccgcgaccttcgatccgctgaaggtgccgttcgccaagctcaagggcgcgcgcggtgcgggtccgctcaccggcaagatccgcatgggcctgatgacccatggcgtcgatgtcatgggcgcgcccggcggcttcgtctcggcgacccatggcggcgccgaaatcgagaggacggtgcacgcgctgcgcgagaccgtccgcgcgctcaaggccgagcgtgaagtgaaggcggcctag

SEQ ID NO: 874 - protein, 466 aa, Unknown; identical to SEQ ID NO: 48
  Obtained from environmental sample
  DOMAIN (53)...(371): Aminotransferase class-III
  misc_feature (1)..(466): Xaa is any amino acid

SEQ ID NO: 875 - DNA, 1344 bp, Unknown
  Obtained from environmental sample
  misc_feature (1)..(1344): n is a, c, g, or t
atgacccaaccgacaccgactgccaccgtgctcgacacctaccgcacgctccacccgaagtcgggcgccctctacgagcgggcgcgcgccgtcatcgcgggcgggatcacccacgacggccgccatctctcgccgtttccgctctacgtcgagcgcgccctcggcccgcggaagtgggacgtggacggccgcgagtacatcgactactggatgggccacggcgcgctctttctcggccactgccaccccgccgtggtcaaggccgtccaggaacaggttgcgcgcggaacccacctgggcgcctcccacgagctcgaggtgcggtgggcggagctgatcaccaagctcgtgccctccgccgaaatggtccgcttcaccatgtccggcacggaggcgacgcacctcgcccttcgcatcgcgcgcgccttcacggggcgccccaaggtggtgaagttccacggccacttccacggctggcacgacggcgtggtggcggcggtcaacccgcccttcgacgtgccgatgtcggctggcgtccccgccgccactctcgatcagctgctgctggccccgcccaatgacatcaaggcagtggagatgctgctcgagcgcggcgacgtggcggcggtgatcctcgagcccgcgggcggccagtcgggaaccacgcccaccatccccggctatctgcaggagctgcggagtctctgcacgcgtcactccgtcgtcctgatcttcgacgaggtcatcaccggcttccgctactcgcccggcggcgcccaggcgtacttcggcgtgacccccgacatgacgacgctcgccaagatcgtcgcgggcggcctcccgggggcggcggtggtggggcgcaagcccatcatgtcgatgatggcgcaccggggcgatcccgcgtgggatcggagtgagcgcgtcgcccagaacgggaccttcaactccagccccgtctgcgccgccgccgccatcgccaccctcgagctcgtgagcgacggctcgctgcacgcccgcgccaacaagctcggcgacgagctccgcaccggtgtcaccgaggtgatgaagcgcgccggtatccccgggacctgcttcggcgaggcgtcgattttccacgtgtccttcgagggcaagccgggcctcgccggcttcgaccgcccgcggcgcggcgacctctaccagcgcctgcgctgcgccctgatcaacaacggggtggactgcgcgagccagcacgggtgggtctccgccgttcacaccgacgccgacatcgagcaaacgatcgccgcccacggcaaggcgttcgcggccatggccgccgacggcagcttccgggggatgtag

SEQ ID NO: 876 - protein, 447 aa, Unknown; identical to SEQ ID NO: 52
  Obtained from environmental sample
  DOMAIN (49)...(375): Aminotransferase class-III
  misc_feature (1)..(447): Xaa is any amino acid

SEQ ID NO: 877 - DNA, 1389 bp, Unknown
  Obtained from environmental sample
  misc_feature (1)..(1389): n is a, c, g, or t
atgagcaccccgccaaccaattcggcgatcatcacggactacaaggcgcggacccaggggtcgggtgcgctgtttgagcgcgcccgcaaggtgctgccgagcggcatcacgcacgatgcgcgctacctcgacccctattcgatccacgtcgccaaggccaaggggccacgcaagtgggacgtcgatggcaacgagtatgtggattacttcggcggccacggcgccatgctgctcggccattcgcaccccgccgtcgtcgaggcggtgaagaaacagatcgagctgggcacccattacggctcgagccacgagctcgaggtgcgctgggccgagctggtgtgcgagctgacgccgtgcgccgagaaggtgcgcttcaccgcatcagggaccgaggcctcgcacatggcgatccgtctcgcccgtgcctacaccggcaaggacaaggtcgtgcgcttcatcggccatttccatggctggcacgacaatgtcacggccggcgccggcgcgacctatgacggcggcaccacaccgggcgtgccgcagcaggtgagcgacctctcgatcgtgatgccgagcaacgacgtcgccgccgtggtcaagctgatcgaggagcgcgacgacatcgccgtggtgatgttcgagccctccggcgcctcctggggccaggtgccgctgccgccgggcttcgtccaggcggtgcgcgacgccacggccaagaagggcgtgctgatgctgatggacgaggtgatcaccggctaccgctggtcgtcgggcggcgcgcagaaggcttttggcatcacgcccgacctctgcatccaggccaagatcgtggccggcggcctgccgggcggcgcggtcgccggcaagcgcgacatcctcgaccgcatcgatcacgacgccaccgcggcgaagaagatcgagcgcatcctccatcccggcacctacaacgccaacccgttgtcggccgcggcggcggtgacggcgctcaccctggtgcgcgacgaggatctcgcggagaaggccaacaagaccgcggccgagctgcgcaaggcgctgaccgaggtgctggtgaaggagggcgtgccgtggggcatctacggccagagctcgaccttcctgatctatcccaatccgttcggcgatccgatcgatcccgcgaccttcgatccgcagaaggtgccgatcgccaagctcaagggcgcccgcggcgccggcccgctcaccggcaagatccgcatgggcctgatgacccacggcgtcgacgtgatgggtgcgcccggcggcttcgtctcggcgacccacggcggcgccgagatcgagaagaccgtccatgcgctgcgcgagaccgtgcgggcgctcaaggccgagcgcgaagtgaaggccgcgtag

SEQ ID NO: 878 - protein, 462 aa, Unknown; identical to SEQ ID NO: 38
  Obtained from environmental sample
  DOMAIN (49)...(367): Aminotransferase class-III
  misc_feature (1)..(462): Xaa is any amino acid

SEQ ID NO: 879 - DNA, 1398 bp, Unknown
  Obtained from environmental sample
  misc_feature (1)..(1398): n is a, c, g, or t
atgagcaccccgaccaatccggcgaccaattcggccatcgtcaccgactacaaggcacggacccagggctcgggtgcgctgtttgaacgcgcccgcaaggtgctcccgagcggcatcacgcacgatgcgcgctatctcgacccctattcgatccacgtcgccaaggccaagggcccgcgcaaatgggacgtcgatggcaacgaatatgtggactatttcggtggccacggcgccatgctgctcggccattcgcaccccgcggtgatcgaggcggtcaagaagcagatggagctgggcacgcactacggctcgagccacgagctcgaggtgcgctgggccgagctggtgtgcgagctgacgccctgtgccgagaaggtgcgcttcaccgcctcgggcaccgaggcgtcgcacatggcgatacgtttggcgcgtgcctacaccggcaaggagaagatcgtccgcttcatcggccacttccacggctggcacgacaacgtcacagccggcgcgggcgcgacctacgacggcggcaccacgccgggcgtgccgcaggaggtgagctctctttcgatcgtcatgccgagcgacaacgtcgccgcggtcgtgaagctgatcgaggagcgcgacgacatcgccgcggtgatgttcgagccgtccggcgcctcgtggggccaggcgccgctgccgccgggcttcatccaggcggtgcgcgacgccacggccaagaagggcgtcgtcatgctgatggacgaggtcatcaccggctatcgctggtcgtcgggcggcgcgcagaaggcgttcggcatcacgcccgacctctgcatccaggccaagatcgtcgccggcggcctgccgggcggcgcggtcgcgggcaagcgcgagatcctcgatcgcatcgatcacgatgcgacggcggccaagaagatcgagcgcatcctccatcccggcacctacaacgccaacccgttgtcggccgccgcggcggtgacggcgctcaccctagtgcgcgacgaggatctctcggagaaggccaacaagaccgcggccgagctgcgcgcggcgctcaccgaggtgctggtgaaggagagcgtgccgtggggcatctacggccagagctcgaccttcctgatctatcccaacccgttcaacgatccggtcgatcccgcgaccttcgatccgctcaaggtgccgttcgccaagctcaagggtgcgcgcggcgcgggtccgctcaccggcaagatccgcatgggcctgatgacccacggcgtcgacgtgatgggcgcgcccggcggcttcgtctcggcgacccacggcggcggcgagatcgagaagaccgtccacgccttgcgcgagacggtgcgcgcgctcaaggccgagcgggaagtgaaagccgcctag

SEQ ID NO: 880 - protein, 465 aa, Unknown; identical to SEQ ID NO: 84
  Obtained from environmental sample
  DOMAIN (52)...(365): Aminotransferase class-III
  misc_feature (1)..(465): Xaa is any amino acid

SEQ ID NO: 881 - DNA, 873 bp, Unknown
  Obtained from environmental sample
  misc_feature (1)..(873): n is a, c, g, or t
atgagcacagtatatttaaatggccagtttatgccggccagcgaagcgcggatttcaccaatggatcgtggctttttatttggtgacggaatctatgaggtgatcccaacctatcacggtcgttatgttggctttgcgccgcatatcgcacggatgcatgaaggcttagctgcacttaatattcagcatggtatgaccgagcagcgctggcgcgagctttgcgatcagctgctcgagctaaaccggccagaactgggtgagaatttgggcgtttatattcaggtcagccgcggtgccgataccaaacgcaaccatgcctttccaagtggtatcagcccaaccatttttgcctatacctttgccatcgccgccgagccggtgccggataaaagcaaggtcagcacctatagtgtggttaccgccaacgacttacgctggcagcgctgccatattaaatccacctctttgctgggtaatgtgctgcattatcaatacggcgtggaacagggcgcgcaggaaaccctgctatttgaccgcgacggcaacttaaccgaaggcgcggcagtaaatgtatttgtggtaaaaaacggcgaaattgctaccccgccgctaagtaataagctgttacccggtgtcacccgcttactgctgctggcgatcctgcgccaacactcggatttaaaggtggtagagcgtgagattagcttcgacgaagtattggctgccgatgaaatctggctaaccagctccagtaaagaaattgcgccggtagttaaggttaatggccagccggtgggggatggcactgtgggtgatatctggctggcggcgcagcggttgtttagtgagcataagtatagtgttgagtgttag

SEQ ID NO: 882 - protein, 290 aa, Unknown; identical to SEQ ID NO: 76
  Obtained from environmental sample
  DOMAIN (7)...(282): Aminotransferase class IV
  misc_feature (1)..(290): Xaa is any amino acid

SEQ ID NO: 883 - DNA, 878 bp, Unknown
  Obtained from environmental sample
  misc_feature (1)..(878): n is a, c, g, or t
atggtttatctgaacgggcgttttgtccccatggaggaagccgtcgttcccatcgaggaccgcggctaccaatttgctgatggtgtctacgatgttttgaaatttcacgggcgttgcgctgtgcggctgacggcccacctcgaacgtcttgcggaaagctgcgcggggttgcgcattgaaggcgtgccttcggcccaggggtggcgctccatcatcgcggagttggccgagcgcagcgaacttggccacacgtttgacgacactgtcattctctacattcaggttacgcgaggagtggcttcgcgcattcactatttccccgagccgcgccccaagcccacggtcctggcctatttcaaagcggctcccgtttaccccgaggcattgcgtcgcgacggggcctcagtgatcacgatgcccgatgagcgctggggtcgctgtcacatcaagagcattgcccttttgcctgtcgtcctggccaagcaagcggcgcgcgaggccggtgctctcgaggcgcttctcgtgcgcgacgggatcgtgactgagggcggcgcgtcgaatgccttctgtgtgcgccagggagtcatcttcacgcacccggagggcccccgcattctctcaggggtcacgcgcggcattgttctcgatgcagcacgacgccttggcattgaggtgcgtgaggagcccgttcccatcgaagagttccgtgcggcggacgaggcgtttctttcgagcacaaccatgaacgtcatgcctgtgacgcgtatcaatggcgctcccgtcggaagcggagctgttggggaagtcacgcgctccatcgcggcggcggtcgaagaactcattcgggaggagcatgaagccaacgcgtccctcggata

SEQ ID NO: 884 - protein, 292 aa, Unknown; identical to SEQ ID NO: 88
  Obtained from environmental sample
  DOMAIN (5)...(278): Aminotransferase class IV
  misc_feature (1)..(292): Xaa is any amino acid

SEQ ID NO: 885 - DNA, 861 bp, Unknown; identical to SEQ ID NO: 19
  Obtained from environmental sample
  misc_feature (1)..(861): n is a, c, g, or t

SEQ ID NO: 886 - protein, 286 aa, Unknown; identical to SEQ ID NO: 20
  Obtained from environmental sample
  DOMAIN (8)...(270): Aminotransferase class IV
  misc_feature (1)..(286): Xaa is any amino acid

SEQ ID NO: 887 - DNA, 801 bp, Unknown
  Obtained from environmental sample
  misc_feature (1)..(801): n is a, c, g, or t
atgggtgcaagcgagacgctggcgtcgatcgacggccagatcgtgccgctcgatcaggcgacgatcctgatcaccgatcagggcctgatccgtggcgacggggcgttcgaagtcgtgcggctcttcgacggtgtgccgttcgcgctggaccagcatttcgagcgcctgcaacgctccgccgaaaacctgctgctcccagtggacgtggagctggtgcacagcgaggcgctggcgctgctggcggccagtaacgccgcgggtgtggagcatcagctgatgcggatcatgctgacccgtggcgggcgacggatcgtgctgaccgagccgatgccgttcgagcccgaggaggcgcgcctgaagacgatcacctaccagccgaccctcgtgctggacggcgtcaagtcgctctcgtatgccgcgaacatgctcgccacccggcgggcggtggcggcgggctacgacgaggcgctgctggtgacgcccgcgggccgggtgctggaagccccgaccgcgtcgctgttctgggtgaagaacggtgagctgcgcacgccgccgctgagcgatcacatcctcgcctcgatcacccgcggcctgctgctggagctcacctccgcggtcgagtacccgacggcgctcccggagctgctcgaggcggatgaggtgttcctcgcctcgaccacccgtgaggtccagccggtctgcgagatcgacgggcgccgcttcctcaccggcggcccggtcgcgagcgcgaccgatcagacggtccaggcccacctcgcggagctgctcgcgcgggcgtag

SEQ ID NO: 888 - protein, 266 aa, Unknown; identical to SEQ ID NO: 28
  Obtained from environmental sample
  DOMAIN (11)...(256): Aminotransferase class IV
  misc_feature (1)..(266): Xaa is any amino acid

SEQ ID NO: 889 - DNA, 840 bp, Unknown
  Obtained from environmental sample
  misc_feature (1)..(840): n is a, c, g, or t
atgcagaaggtttttttaaacggtgaatacctgcccttgccggaagccaaggtttcggttctggatcgcggttttttgtttggcgatggcgtttacgaagttattccggtctatgcggggcatttattcaggatggccgaccatatcgagcggttgaacaatagcctggcgggtatacgtctgcctttggattatagcgtcgacgactggcgggcgatttttgcgcctttgttggacggcggcaaggatcaatatatctatttacaaattacccgcggctatgcgccgaaacgcgatcacgcttttcctgaacaagtcataccgactatttttgccatgtgttcggatattacgcctttcccggaaaaatttaccggcatcaaagccgtctccgtggacgatatccgctggcaactatgccatatcaaggccattaccttgctggccaacattctgttgcggcaacaggccgtcgagcagggcggtgccgaggctattctggtaaaaaacggctatgttatcgaaggagctgcgagtaacgtttttaccgtgatcgatggggtattgattaccccgccaaagtcgaatgagattctgcccggtatcacccgcgatgttgtcctgaagctggcgcaagcccatggcttgccgttccgggaagatattatcgccttggaagcgttacgctccgccgacgaaatttgggtcgccagttccatccgggaaattctgccggtcgtggaattggacggagtagccgtagccggcggcaaacccggagcgatatggcgcgacatggataactatttgcaagcctataagaaatcctgtcatgactag

SEQ ID NO: 890 - protein, 279 aa, Unknown; identical to SEQ ID NO: 26
  Obtained from environmental sample
  DOMAIN (7)...(271): Aminotransferase class IV
  misc_feature (1)..(279): Xaa is any amino acid

SEQ ID NO: 891 - DNA, 861 bp, Unknown; identical to SEQ ID NO: 21
  Obtained from environmental sample
  misc_feature (1)..(861): n is a, c, g, or t

SEQ ID NO: 892 - protein, 286 aa, Unknown; identical to SEQ ID NO: 22
  Obtained from environmental sample
  DOMAIN (8)...(270): Aminotransferase class IV
  misc_feature (1)..(286): Xaa is any amino acid

SEQ ID NO: 893 - DNA, 861 bp, Unknown; identical to SEQ ID NO: 23
  Obtained from environmental sample
  misc_feature (1)..(861): n is a, c, g, or t

SEQ ID NO: 894 - protein, 286 aa, Unknown; identical to SEQ ID NO: 24
  Obtained from environmental sample
  DOMAIN (8)...(270): Aminotransferase class IV
  misc_feature (1)..(286): Xaa is any amino acid

SEQ ID NO: 895 - DNA, 849 bp, Unknown
  Obtained from environmental sample
  misc_feature (1)..(849): n is a, c, g, or t
atgaaagagctgggctattacaacggaaaaatcggggaattaagcgaaatgaccgtgcccatgaatgaccgggcctgctggtttggggacggggtctatgaggccggcatgtgccgggatgggcagatcttcgccctggatgagcatgtggatcggctctttcgcagcgcggccatgctggaaatccgggttcccgtttccaaagaggagctgaagcagctgttatatgatcttatcggaaagatggataccggcgatctcctggtgtattatcaggtcacccggggctgcggtccccggggccacgccttccccgatggtcccgccagcctgtgggtcaccctgcggccgaaaaccctgaatccctttctgcctcccgtctccctgatcacggatccggatacccgctttttccattgcaatatcaagaccctgaacctgatcccctcggtcatggcgaatgagaaggccaggcgggccggctgttacgagtgcgtgctgtatcggcccggcggccgggtcacggaatgctcccacagcaatgtgcatatcatccgggacggcgtcttcatcaccgccccgacggatgagctcatcctgcctgggatcgcccgggcccatctgatcagggcttgttccgcgctggggatccccgtccgggaaactcccttcaccgtggaggatctgaaagccgccgacgagatcctgacctccagctccaccgcgccctgcatccgcgcctgccgggtcgacgggcaggcagccggtatgcggcggccggatctgtttgatgcgctgcatcgggcggtttttgatgagtattttggaaatcaggggtggaggtcatag

SEQ ID NO: 896 - protein, 282 aa, Unknown; identical to SEQ ID NO: 30
  Obtained from environmental sample
  DOMAIN (8)...(271): Aminotransferase class IV
  misc_feature (1)..(282): Xaa is any amino acid

SEQ ID NO: 897 - DNA, 1353 bp, Unknown
  Obtained from environmental sample
  misc_feature (1)..(1353): n is a, c, g, or t
atgagcatcctcagcacctacgaagcgaagcaccccacctcggccgagctgcaccggcaggcgcaggggatattcccggacggcgtcacgcacgatgcccgctacttcacgcccttcccgatctacgcggagcggtcgcagggcagccacaagtgggacgtggacgggaacgagtacatcgactacgtctccggtcatggcgccctgctgctcggccacggtcgggcagaggtgacgcaggctgtggcacaacagatcgcgcggggcacgcacctcggggcatcgacgccgctggagatcgagtggggtcgctgggttcagcggttgatcccgagcgcggaacgggtgcgtttcaccagttcgggtaccgaagccgtgcaaatggctgtgcggctggcccgggccttcaccggccgcgacctgctgatcaagttcgagggacatttcaacggctggagcgacaccgtctccgccaacctgctcgcgggccacgacggtcccgcctgcgtcggcgtgcctgacgcggccaccggcctccaactgatcctccctcagaacgacatcccggccttcaccctggcgatggaggagcacgcgggcagggtcgccgccgtgatcctggagccgacgggcgcctcgatgggtggaatcccgatcgagccggagttcctcttcgccctccgggagcagacggagcgcaccggcacgctcctgatcttcgacgaggtcgtgaccggcttccggatcgcgccgggcggtacgcaggcgtacttcggcatcacgccggacctgaccacactcgccaagatcctggcgggaggtctgcccggcggcgccgtcggcggacgagcggagattctgggccagattgagttcaacccggagcactccccagcgggccgtatcgcccaccctggcacgttcaacgcgaacccgctctccgctgcggcgggcgcggcggcgctggcgatcgtcgccacgggcgagccgcaccggcgggcgaacgccgccgccgccaccctggcgcgggagatgaacgatgccctcgcgcggcgggagatcgacggctgcgtctacggcctcggctcgctgctgcacatcctgctgggcaagccgtgcgctcgtcccgaggacgggctgacctgggtctgggagggagagcaccgctcggccgtgccgcgtacgtcgccggagctggtcacggccttccgccgcggcatgctcaaccacggcgtcgatccgatggccacccggttgatcgtcggcgcggagcactcggacagcgacgtggccgccacgatcaccgcgttcgaggcgacgctggacgagatgcgggaggagcagttcctgtaa

SEQ ID NO: 898 - protein, 450 aa, Unknown; identical to SEQ ID NO: 50
  Obtained from environmental sample
  DOMAIN (42)...(371): Aminotransferase class-III
  misc_feature (1)..(450): Xaa is any amino acid

SEQ ID NO: 899 - DNA, 1362 bp, Unknown; identical to SEQ ID NO: 127
  Obtained from environmental sample
  misc_feature (1)..(1362): n is a, c, g, or t

SEQ ID NO: 900 - protein, 453 aa, Unknown; identical to SEQ ID NO: 128
  Obtained from environmental sample
  DOMAIN (64)...(440): Aminotransferase class I and II
  misc_feature (1)..(453): Xaa is any amino acid

SEQ ID NO: 901 - DNA, 1386 bp, Unknown
  Obtained from environmental sample
  misc_feature (1)..(1386): n is a, c, g, or t
atgcctgacaccaacctgacgaactcgaagatcgtcgcggcctatcgcgagcgcacaccgggctcagcgagccttgcggccaaggcgcaggagctgctgccgagcggcatcgcccacgacgcccgcttcatgaagccctacggcatctatgtcgagcgagccaagggcccgcgcaaatgggacgtggacggcaacgagtacgtcgactatttcggcggacacggcgcgttgctcctcgggcacaaccatccgagcgttgtggccgcgagccacgcggcgctcgagcaaggcacgcatttcggcgccaatcatccgcgcgaggtccgctgggccgaactggtgcgcaagctggtcccctcggcggagagcgtgcgcttcacctcgtccgggaccgaggccacgttgatggcggtgcggctttcgcgctcggtcaccggcaagcccaaagtcgtgcgcttcctgacgcatttccacggctggcacgaccacatgacctcgggccacgccaaccatttcgacggcacgccgacggcgggcgtgctggccggcgtcgccgagcacgtgatcctgctgccgcctggcgacgtcgaagcggtaaagagcacgttcgccagccgcaacgacatcgcctgcgtgatcctggagccgaccggcacgagcttcggcgcggcgccgctgccgccgtccttcctccgcgtcctgcgcgaggagaccgagaagcacgggatcttcctgatcttcgacgaggtggtgacgggatttcgcgtctcgcccggcggcgcgcaaggcgagttcggcatcaagcccgacctgacgtcgctcgccaagatcctggcgggcggattgcccggcggcgcggtcgtgggccggcgcgacattctggacgacctcgacttcgacgcggtcgagcgcaagaagcgcgagaagatcgcgcaccccggcacctacaatgctaatccgctatccgccgccgccggcatcgccgcgctggagatcgtcggcaccggcgagccctgcaagcgggccagcgccacggccgcctcgctccgcgcggcgctcaacgacgtactggcggaggagcgcgtaccttgggcggtctacggctccttcagcggattccatttcttcctgaatgcgaagcagcgggcggtcgacccgttgcgcttcgatccgatgacgctcgactacaaagagctgctgagcaatccacccgcgctcgcgcgcttgctgcgcctggcgctcctcgccaacggcgtcgacgtcaacggccgggcaagcggcttcacctccgcggcgcatgggcctgcggagatcgaggaaaccgcccgtgcgctccgccagagtctccgcatgctgcgcgccgagggcgagctgccggctcgatag

SEQ ID NO: 902 - protein, 461 aa, Unknown; identical to SEQ ID NO: 138
  Obtained from environmental sample
  DOMAIN (5)...(363): Beta-eliminating lyase
  misc_feature (1)..(461): Xaa is any amino acid

SEQ ID NO: 903 - DNA, 1383 bp, Unknown
  Obtained from environmental sample
  misc_feature (1)..(1383): n is a, c, g, or t
atgccggatacgctgacgacaaactcgccgatcatctccgcctaccgcgccgcgacacccggctcggccgagcacgcgcaacgcgccgccgagatgttcccctccggcatcacccacgattcgcgctacatcgagccctacgggatctacattgcgcgcgcccaggggccgcgcaaatgggatgtcgacgggcgctgctatgtcgattatttcggcggccatggtgcgctgctgctcggccattgccatcccgaagtgatggcggcggtacacgcccaactcgaccgcgggacccattacggcgccagccacgagctggagatcgaatgggccgagcgggtcaaggcgctgatcccgaccgccgagcgcgtgcgtttcacctcatcgggcaccgaggcgacgctgatggcggtgcgcctcgcgcgcgccttcaccggcaagccgaagctgatccgcttcaactaccatttccacggctggcacgaccacatgacgtccggccacgcgaaccatttcgacgggacgccgacgaccggcgtgctcgacgcggtggccggcaacgtccttctgtgcgaccagaatgacgaggcggcgctggcgcggctgctcgaccggcatcacggcgagatcgccgcggcgatcatcgagccgactggcgccaacggcggcaaattgccgatcgacccggatttcctccaggcgctgcgccggctcaccagcgagcatggcgtgctgttgatctttgacgaggtggtgaacggtttccgggtcgcgccaggcggcgcgcaggaggcctacggcatccggcccgatctcacaaccctggcgaaaatcctcgccggcggactgccgggcggcgccgtaaccggcagaaaggacatcctcgacctcctcgacttccaggttaccaaaggcgccggcaaggagaagatcaaccatcccggcacattcaacgccaacccgctgtcggccgccgccgggattgccgccctcaagatcgtgcgcgagagcgacgcctgcgcccgcgccaaccattacggcgacgagctgcgccgccggctcaacgaggtgtttgaggaggagcggatgccgtgggccgcgtacggcaccttctcgacccttgaattgttcaccaaccccgagggcaaaaagatctcgccgagcaccttcgatccgctagaggaatcgttcgccagcctcaaaggcgagcgcaacgccggcatcatccacaagctgcgcctcggcatgatgatccacggcgtcgacttgtcgagccatccgggcggcgtcatctcgtgcacgcacggcgaagccgagatggaggacaccgtcaaggcgatgcgaagcaccgtgcgcatgctgcgcgccgagggtgagctgtag

SEQ ID NO: 904 - protein, 460 aa, Unknown; identical to SEQ ID NO: 140
  Obtained from environmental sample
  DOMAIN (50)...(378): Aminotransferase class-III
  misc_feature (1)..(460): Xaa is any amino acid

SEQ ID NO: 905 - DNA, 864 bp, Unknown
  Obtained from environmental sample
  misc_feature (1)..(864): n is a, c, g, or t
atgcgtaccgtctatgtgaatggcaaatttctgcccgaggccgagggtatggtttcgatcttcgatcgcggcttcaccatgagcgacagtgtctacgaagtgaccggcgtcgtcgccggcaagatgctcgacttcgaccctcatatggcccgcctgcagcgctccatgagcgagctcggcatgccaaaaggccccggggccgatgccttaaaggcaattcatctgaagatgatcgagctgaacaaactcgacgaaggcctggtctatctccagattacccgcggggtgcaggaccgcaatttcgagcttcccgcagcagacaaccccttgaccatcgtgctgttcacccaggcgcgcccggtggtggaatctgcgcaggccgagcgcggcatcaaggtcatcagcctgccggatctgcgctggcaccgcagcgacatcaagacgacgcagctcctctatgcctgccttgccaaggacgcagcgaagaagcggggctgcgacgatgcctggctggtgcgcgacggtctggtgaccgagggcagcgccaacaatgccttcattgtcacgcgggacggacttgtcatcacgcgtgacctttccaccgagcttcttcccggcattacccgcaagcggatcgtcgagctggcggcaaatcacggctatcgcctcgaacaacgtgccttcaccattgccgaggcgaaggccgcggtcgaagccttcatcacctcggcaacgcagttcgtcatgccggtggtggaaatcgacggcgcggcaattggccagggcaagccaggcaaattcagtgttgcacttcgcaagctttacatcgaagaaacgctgtcgcgcgccgggatcaggcgatag

SEQ ID NO: 906 - protein, 287 aa, Unknown; identical to SEQ ID NO: 130
  Obtained from environmental sample
  DOMAIN (7)...(276): Aminotransferase class IV
  misc_feature (1)..(287): Xaa is any amino acid

SEQ ID NO: 907 - DNA, 831 bp, Unknown
  Obtained from environmental sample
  misc_feature (1)..(831): n is a, c, g, or t
atggctgctgacgtggtctggctcaacggggccgtcgtgcccgccgccgaggcgacggtctccatcttcgaccacggcctcacggtgggcgacggcgtgttcgagacgctcaaggcgaccgccggggtgcccttcgcggcgcgccgccacctcgagcggctccggcgctccgccgacgggttggggctgaaggtgccgtggaccgacgacgacctgcgggccgcgatggaggccgtgctggccgggctcgacctgcccctggcccgggtccgcatcaccgtcaccggcggcgccgcccccctcggctccgatcgcggggacgggccgcccacggtcgtcgtggccggcgggccgctggcccggcccgcgcccaccaccgacgtctgcacggtgccgtggccccgcaacgagcgcggcgccctcgccggcctcaagaccacctcctacgccgagaacgtccgggccctggccgtcgccaaggagcagggctgcaccgaggcgctctacgccacgacgacgggcctcctctgcgagggcaccggcgccaacctcttcctcgtccacgagggccgcctcgtcacgccgacgctcgccagcggctgcctggccggggtcacccgcgccctggtcctggaggtcaccgacgccgtcgaggtcgacctgccggcggaggcgctggctggcgccagcgaggcgttcctcacgtcgacgggccgtgacgtgcaggccatcgcgcacgtcgacggccgcgcctacgacgcgccgggcccgcagacggccgcggccgcgaaggccctcgccgcgctggaggccagcaaccccgacccctag

SEQ ID NO: 908 - protein, 276 aa, Unknown; identical to SEQ ID NO: 126
  Obtained from environmental sample
  SIGNAL (1)...(18)
  DOMAIN (9)...(267): Aminotransferase class IV
  misc_feature (1)..(276): Xaa is any amino acid

SEQ ID NO: 909 - DNA, 855 bp, Unknown
  Obtained from environmental sample
  misc_feature (1)..(855): n is a, c, g, or t
atggcttattcattatggaatgatcaaattgtggaagaaggatccattgcggtatcaccagaagatagaggctatcaatttggtgacggcatttatgaagtaatcaaagtttataacggaaatatgtttacagcacaagagcatattgatcgtttctatgcaagcgccgaaaaaattcgtcttgttattccttatacaaaagacgttttacacaaattattacatgagctaattgaaaaaaataatctagatacagggcatgtttatttccaaatcacacgtggtgccaattcacgtaatcacgttttcccagatgcaagtgttccagctgtattaacaggtaatgtaaaagcgggtgaacgtgcatatgagaactttgaaaaaggggtaaaggctacgtttgtagaggatattcgttggttacgctgtgatattaaatcgttaaacttacttggtgcagtattagcaaaacaagaggctgctgaaaagggctgctatgaagcgattttacatcgtggggatatcgtaacagaatgctcatcagcaaatgtttatgggattaaagacggtaagctttatacacatccagcaaataacttcattttaaacggtattactcgtcaagtgattttgaaatgtgcagaggagattagtttacctgtcgtggaagaaccaatgacaaaagctgatttattaacaatggatgaaatcattgtatcatctgtatcttctgaagttacacctgttattgatgtggatggtaaccaaattggtgcaggagtgccaggtgaatggacgcgtaaattgcaacaagcttttgaggcgaaattaccactttctttgaatacaaaataa

SEQ ID NO: 910 - protein, 284 aa, Unknown; identical to SEQ ID NO: 132
  Obtained from environmental sample
  DOMAIN (7)...(274): Aminotransferase class IV
  misc_feature (1)..(284): Xaa is any amino acid

SEQ ID NO: 911 - DNA, 876 bp, Unknown
  Obtained from environmental sample
  misc_feature (1)..(876): n is a, c, g, or t
atgagcggaccgctcccgatctgctacctgaacggcgagttcttgccgttgcgcgacgcccgtgtatcgcccttggaccgcgccttcctgttcggcgatgcggtgtacgaggtggtgccggtctacgatgcgcgcccgttccggctgcgccagcacctggagcgcctcgaccgcagcctcgccggcatccgcatgccgccggccctgccgcacggcgactgggcacacatctgccaggagctgatccgccgcaacgacgccgacgaggcctacgtatacatgcaggtgagccgcggtgcggagtatggccgcaatcacgcctggcccgaggacttgaagcccaccctgttcgcctatatttcggcgatggacgggctctcgaacgccctcatcgagaagggcgtggccgcggtgaccgccaaggaaatccgctgggcgcgtcgcgacatcaagtcgaccgcgctattgggcaatattctcttgaagaagctggcgcaggagcgcggcgccttcgagaccatcatgctggagaacggcgaattgaccgagggctcatccaccaccgtgcacgtgatcaagaacggcatcattcacacgccgccgaacggccagaagatactgcccggcaccacgcgcgatgtggtgaccgagcttgccgggttgctgtccatcccctgcaagagcgcgccggtgagcgaagcggagctgcgcgcagcggacgagatctggctcgcctttgccacccgcggggtgcttgccgtgacggcgcttgacggcgagccggtgggcggcggcaaaccgggtccgctgttcgctcgcatgcgactcgcgttcgccaactatgcacgcgacctcaagggcagtccggcgctatag

SEQ ID NO: 912 - protein, 291 aa, Unknown; identical to SEQ ID NO: 134
  Obtained from environmental sample
  DOMAIN (11)...(279): Aminotransferase class IV
  misc_feature (1)..(291): Xaa is any amino acid

SEQ ID NO: 913 - DNA, 852 bp, Unknown; identical to SEQ ID NO: 151
  Obtained from environmental sample
  misc_feature (1)..(852): n is a, c, g, or t

SEQ ID NO: 914 - protein, 283 aa, Unknown; identical to SEQ ID NO: 152
  Obtained from environmental sample
  DOMAIN (8)...(275): Aminotransferase class IV
  misc_feature (1)..(283): Xaa is any amino acid

SEQ ID NO: 915 - DNA, 1383 bp, Unknown; identical to SEQ ID NO: 147
  Obtained from environmental sample
  misc_feature (1)..(1383): n is a, c, g, or t

SEQ ID NO: 916 - protein, 460 aa, Unknown; identical to SEQ ID NO: 148
  Obtained from environmental sample
  DOMAIN (49)...(375): Aminotransferase class-III
  misc_feature (1)..(460): Xaa is any amino acid

SEQ ID NO: 917 - DNA, 915 bp, Unknown
  Obtained from environmental sample
  misc_feature (1)..(915): n is a, c, g, or t
atgaaaggaaatactaatgccgacctttcctcagtggatctgcccggggcaggttctacagccgtgtatcctaccaaggtatttctgaatggcagcatagtcgatgctgaaaacgcaaaggtttccgtctttgatcggggttttatctttggcgacgggatctatgaagtaatggcccggatcaatggcgttttcttctatggcgatgcccattgggaacgattggaaacctgcctgcagaagatcggcctggtctacgacatatcaattctaaaggacgcgatcccggaattgctggaagcatccggaataggtcaggaagattgtatggtctatatccaggtaaccaggggaacggcccccaggcagcatggctaccctcccagcccccaacccactgcaatgatgtacgcctggaagaagaccctcccggccattgaaacaaagcattcccgtgtagttaccctggaggattttcgttggtctcgctgcgatattaaaatgacgtccctcttgggcaatgtcatggcaaacgaatgggccatggagaacgaggcctacgaaaccgtcctgatccgaaatggcgtagccacagaggcatcccactgtaatgttttcttcgtgaaggacggtacggtatggacccaccctgcggaccatcatatcctcgacgggatcacacgccaggtagtcctggaaatttgtgaggagctcggcatcccggttagacttgagggtataccggcggataaattgaaacaaatggacgaggccttccttacgggcaccggatcacaggtacgggccatacaggagctcgacgaccatccgtattttaaaacccatccgggtcctgtaacccttcggatacaacgcacattcctagaacttaaaagcggaaagatctcgttctag

SEQ ID NO: 918 - protein, 304 aa, Unknown; identical to SEQ ID NO: 144
  Obtained from environmental sample
  DOMAIN (30)...(295): Aminotransferase class IV
  misc_feature (1)..(304): Xaa is any amino acid

SEQ ID NO: 919 - DNA, 1350 bp, Unknown
  Obtained from environmental sample
  misc_feature (1)..(1350): n is a, c, g, or t
atggctctcgaacaggtctatcgtcaagcgcttccggcctcgcacgccctctttgagcgcgcccaaaaccttttccccgacggggtcacccacgacaaccgccggatgcagccttttcccatctttgtcgaacgtgccgatggggcgtacaaatgggatgccgatggccggcagtatatcgactactggatgggccatggtgcactcattatggggcataaccctccgcacgtgcgcgatgccgtcatcgagcaagcggcgcgtggcacgcactacggcgccagtcatgctctcgaagtggtatgggccgaatgggtctgtaagctggtgccctgtgctgagcgcgtgcgctttacggcctcgggcactgaggcgacgcacatggccctgcgtctggcccgcgcctatacgggcaagcggcgcgtgatcaaattcgccgggcactttcacggctggcatgagggcctggaagtgggtgtacagaccccctatgaaacagtgccagagccagggcaaatgcaagaagcggtagacgccgtcgccctgtgcccaccgaacgacattgaggccgtccgggctgcccttgccgctggtgacgtggccgctattatcctcgaacccacgggtggccactttggcacggtgccggtggcgccgggttttttacggtgtctacgggaagaagccaccagggctggggtggtgctcatcttcgacgaagtagtgacgggttttcgtgttgcgccaggcggtgcacaggaactctacggcgtcactcctgacctttcgacgtttgctaaaattctcgctggcggtctgcctggtggggctgttgctggccgggccgagatttttaactatctggcgacgccaacagccgctgagataggaaaacgtgcaaagattcaccatcccggcacgttcaacgccaatcccctctcggccgcggccggcgtggcgatgctgtcctctctggccgatggcacatgcatcaagcgcgccaacgagcaggctgccaagctacggcatggtatgaacgacatcctcgcacgcgaaaaagtcgcctggaaagtctatggccagcacagcgactggaaactgttctacggcgctggtgccccaccgcgtgatggcgctgaccagtccgtggatgacatcccctggcagcgcctggacggcaaattcccgcagcagagccgggccatgcggcaagcgctcatcctgcaaggtattgactttaacggggcgcgtgctctcgtaggtacctgccacactgacgacgtcgtcgctgagaccctggcgggctttgcagaggcggtacgggccgtcaaagccgacgggctcgcgtag

SEQ ID NO: 920 - protein, 449 aa, Unknown; identical to SEQ ID NO: 146
  Obtained from environmental sample
  DOMAIN (42)...(355): Aminotransferase class-III
  misc_feature (1)..(449): Xaa is any amino acid

SEQ ID NO: 921 - DNA, 1377 bp, Unknown
  Obtained from environmental sample
  misc_feature (1)..(1377): n is a, c, g, or t
atgagcgtgcactcggtcactgagctccatgcagcctatgccgcgaaatttccccgatcggcggcctcggcccgcgccgcgaacgaggccatcgccggtggcgtggcgcatgatgggcgtgctgcctcgccgttcccgctctttatcgacagcgcccagggcgcgcgcaagcgcagcgtcgatgggcacgacctgatcgatttctggatgggccatggcgcgttgatgctgggccaccgccatcccgcgatcgaggcggccgtggcccagcagcttgcccggggaacgcactttggcgccagccacgaggccgaggtgcagtgggcgcagaagatcatcgaactggtcccttcggccgagctggtgcgcttcgtggcgtcgggaacggaagcgacgcacatggcgctgcgcctggcgcgggcagccacgggccgctcacgcatctgtcgcttcgaggggcatttccacggctggcacgactgggtcgccctggggaaccgtgcgcccttcgaccaaccaagctccggggggattgctccggcggtgcgcgacgagatcacggttctgcccaacaacgatgccaacgcgttgcgcgcggcgctggcggctggtgatgtggccgccgtcatcctcgaacctgggggcggcacgcagggacgggttcctctctgttcggaatttctctgtgaagtacgagacctgacgtcgcggcaggggacggttctgatcttcgacgaggtggtgacggggtttcgcatcgcgccgggtggtgtgcaggagcggagtggcgtcgtgcctgacctgacgaccctggccaagatcgtggctggcgggctgccgggtggggccgtttgcggcaagcgggaggtgatggatgtcctctcctttgcgccgcctgctggcgtgacgcgcgtggcgcaccccggaacgttcaatgccaatccgctcagtgccgccgctggcatcgcgatgctggaggaggtcgccgatggtggcccgctggacgatgccgccgcgagtgcggccatcctgcggcgcggcatcaacgatctcctggccgcgcgcggcatcgctggctttgcctatggcgatcgttccatcgtgcacatcctgctcgggccggccggacggcgagcgcgggcggctgacggtaatcttgacaccatccccgccgccgagttgctggcggccgatccggtcgtggcgaaagccttgcgcaccgcctgcctctttcacgggctggatctgatggggccgacgatgatggtcgcgagcgtccacgatgccgccgcgatcgacgaggcgctgacgaggttcgagcgggtgttcgccacgctgatggcgcttgacgagtgccaaccgattttggaggcctag

SEQ ID NO: 922 - protein, 458 aa, Unknown; identical to SEQ ID NO: 164
  Obtained from environmental sample
  DOMAIN (48)...(364): Aminotransferase class-III
  misc_feature (1)..(458): Xaa is any amino acid

SEQ ID NO: 923 - DNA, 861 bp, Unknown; identical to SEQ ID NO: 161
  Obtained from environmental sample
  misc_feature (1)..(861): n is a, c, g, or t

SEQ ID NO: 924 - protein, 286 aa, Unknown; identical to SEQ ID NO: 162
  Obtained from environmental sample
  DOMAIN (8)...(278): Aminotransferase class IV
  misc_feature (1)..(286): Xaa is any amino acid

SEQ ID NO: 925 - DNA, 1377 bp, Unknown; identical to SEQ ID NO: 149
  Obtained from environmental sample
  misc_feature (1)..(1377): n is a, c, g, or t

SEQ ID NO: 926 - protein, 458 aa, Unknown; identical to SEQ ID NO: 150
  Obtained from environmental sample
  DOMAIN (49)...(367): Aminotransferase class-III
  misc_feature (1)..(458): Xaa is any amino acid

SEQ ID NO: 927 - DNA, 1185 bp, Unknown
  Obtained from environmental sample
  misc_feature (1)..(1185): n is a, c, g, or t
atgagaaaaggacttgcaagtagggtaagtcacctaaaaccttcccccacgctgaccataaccgcaaaagcaaaagaattaagggctaaaggagtggacgttataggttttggagcgggagaacctgacttcgacacacccgacttcataaaggaagcctgtataagggctttaagggaaggaaagaccaagtacgctccctccgcgggaataccagagctcagagaagctatagctgaaaaactactgaaagaaaacaaagttgagtacaaaccttcagagatagtcgtttccgcaggagcgaaaatggttctcttcctcatattcatggctatactggacgaaggagacgaggttttactacctagcccttactgggtaacttaccccgaacagataaggttcttcggaggggttcccgttgaggttcctctaaagaaagagaaaggatttcaattaagtctggaagatgtgaaagaaaaggttacggagagaacaaaagctatagtcataaactctccgaacaaccccactggtgctgtttacgaagaggaggaacttaagaaaatagcggagttttgcgtggagaggggcattttcataatttccgatgagtgctatgagtacttcgtttacggtgatgcaaaatttgttagccctgcctctttctcggatgaagtaaagaacataaccttcacggtaaacgccttttcgaagagctattccatgactggttggcgaataggttatgtagcgtgccccgaagagtacgcaaaagtgatagcgagtcttaacagccagagtgtttccaacgtcactacctttgcccagtatggagctcttgaggccttgaaaaatccaaagtctaaagattttgtaaacgaaatgagaaatgcttttgaaaggagaagggatacggctgtagaagagctttctaaaattccaggtatggatgtggtaaaacccgaaggtgccttttacatatttccggacttctccgcttacgctgagaaactgggtggtgatgtgaaactctcggagttccttctggaaaaggctaaggttgcggtggttcccggttcggccttcggagctcccggatttttgaggctttcttacgccctttccgaggaaagactcgttgagggtataaggagaataaagaaagcccttgaagagatctaa

SEQ ID NO: 928 - protein, 394 aa, Unknown
  Obtained from environmental sample
  DOMAIN (32)...(387): Aminotransferase class I and II
  misc_feature (1)..(394): Xaa is any amino acid
MRKGLASRVSHLKPSPTLTITAKAKELRAKGVDVIGFGAGEPDFDTPDFIKEACIRALREGKTKYAPSAGIPELREAIAEKLLKENKVEYKPSEIVVSAGAKMVLFLIFMAILDEGDEVLLPSPYWVTYPEQIRFFGGVPVEVPLKKEKGFQLSLEDVKEKVTERTKAIVINSPNNPTGAVYEEEELKKIAEFCVERGIFIISDECYEYFVYGDAKFVSPASFSDEVKNITFTVNAFSKSYSMTGWRIGYVACPEEYAKVIASLNSQSVSNVTTFAQYGALEALKNPKSKDFVNEMRNAFERRRDTAVEELSKIPGMDVVKPEGAFYIFPDFSAYAEKLGGDVKLSEFLLEKAKVAVVPGSAFGAPGFLRLSYALSEERLVEGIRRIKKALEEI

SEQ ID NO: 929 - DNA, 969 bp, Unknown
  Obtained from environmental sample
  misc_feature (1)..(969): n is a, c, g, or t
atgagcatgtccttcatggaaaccgtattttcaggtcacgcagaacgtgtcgccgcgctagaagcaagcgacagcgctttcgccaagggcgtggcgtgggtcgatggcgaacttgttccgcttcacgaggcccgcattccgcttctcgatcagggtttcctgcactccgatctgacctatgacgtccccgccgtctgggatggcaggttttttcgccttgatgaccatctcgatcgatttgaggcgagctgcgcgaaactgaagctgaaaagcccgatggatcgcgaaaccatgaaggcaacgcttgtcgagatggtcgccaaaagcggcattcgtgatgcctatgtggaaatgattgtcacgcgtggcctgaaattcgtacgcggcaacaaacccgaggacatcgtaaattcgctttacatgctggtcatgccctatgtgtgggtgatgtcaccggagatacagcgtgttggcggcagtgctgtcatcacccgcacggtgcgccgtgttccgccgggcgccatcaacccaacgatcaagaatctgcaatggggtgatttcgtgcgcggtctgatggaagcgcaggatcgcggcgccatttacccgatccttcccgatggtgacggtaacatcaccgaaggctccggtttcaatgtgttcctggtcaagaatggcgtgctttacacaccggaccgtggcgttctggaaggtgtgacgcgaaaaaccgtgttcgatatcgccgctgccaagggctggaaggttgcccttgaacatgtgccggttgaacttgcctatcatgccgacgaaatatttttctgcacgacggcgggcggcatcatgccggtcacaacattggatggagaacttgttggcggcggacaggttggcccggtcacccgcgcgatctgggacgaatattggaagctgcattacacagcagatttgagttttgcgatcgactatccctga

SEQ ID NO: 930 - protein, 322 aa, Unknown
  Obtained from environmental sample
  DOMAIN (35)...(307): Aminotransferase class IV
  misc_feature (1)..(322): Xaa is any amino acid
MSMSFMETVFSGHAERVAALEASDSAFAKGVAWVDGELVPLHEARIPLLDQGFLHSDLTYDVPAVWDGRFFRLDDHLDRFEASCAKLKLKSPMDRETMKATLVEMVAKSGIRDAYVEMIVTRGLKFVRGNKPEDIVNSLYMLVMPYVWVMSPEIQRVGGSAVITRTVRRVPPGAINPTIKNLQWGDFVRGLMEAQDRGAIYPILPDGDGNITEGSGFNVFLVKNGVLYTPDRGVLEGVTRKTVFDIAAAKGWKVALEHVPVELAYHADEIFFCTTAGGIMPVTTLDGELVGGGQVGPVTRAIWDEYWKLHYTADLSFAIDYP

SEQ ID NO: 931 - DNA, 1560 bp, Unknown
  Obtained from environmental sample
  misc_feature (1)..(1560): n is a, c, g, or t
atgtttgcggcggaggtcctgcctctgccgcccgggttccgcgccattgcggaaaagcctgaacgaggaaaaaagaccatgggcacgcagctctcaaactctcttgtccatgcggacatctcgaccacccttcatccctacaccgacgcccgtgcgcatgaaaagcagggcccgatgatcatcgagcgcggcaagggcatctacatctatgacgacgccggcaaggaatatatcgaaggtctcgccggtctctggtcggtcgccgtcggttttgacgagccgcgccttgtaaaggctgccgccgaccagatggccaagctgccctactatcataccttcagccacaagtcgcacgagccctccatccggctggccgagaagatcgtggaaatgacgcccgagcagctgacgcgcgtcttcttcaccagctcgggatcggaagccaacgacaccatgatcaagatggtgtggttcatgaacaatgcgctgggccgcccgcagaagaagaagttcctcgcccgcacccgcggctatcacggtatcacggtggcatccggcagtctcacgggcctgccgaacaatcatcgcgatttcgacctgccggccatcccggtccgtcacctgagctgcccgcaccactatcgcgtcggcctgcccggagaatccgaggcgcagttcgcgcagcgcctgattgccgaggccgaagccgtgatcctcgaagaaggcccggacacgattgccgccttcatcggcgagccgctgatggctgcaggtggtgtcatgcctccgccggccggttactggcagggcatcgaggcgctgtgccgcaagtatgacatcctgcttgtcgccgacgaagtgatctgcggcttcggtcgtctcggaaccgggttcggctgcgaatactacggcttcacaccggacatcatggtcgtctccaagcagctgacctcgtcctatatgccgcttgcggccgttgtcttcagcgaggcggtctacaacgccatcgccgacaacacggccaagatcggcacgttcggccatggcttcaccgcctccggccatccggttgccaccgccgttggtctggaaaacctcaagatcatcgaagagcgcgatctgatcggcaacgccgcccgcatgggcgccattctccaggcacgtctggcggaactggcggatcacccgctggtgggcgaagtgcgcggcgccggcctcatcgccggtctcgagctggtcgccgacaaggaaacgcgccgccccttcgccacggtcggcaaggcgggtgcccgcgcgttcgcagccggacatgagcatggcctcatcgtgcgcgccatcggcgacgtcgtcgcgctctgcccaccgctcatcatcaatgaggagcaggtgaacgaaacggtgaaccgcctgcgcaaggcgctcgacgacacggccaagtggcgtgctgacgagaacctgaacaagggcgagctcaattcgaagcttgaaggtaagcctatccctaaccctctcctcggtctcgattctacgcgtaccggtcatcatcaccatcaccattga

SEQ ID NO: 932 - protein, 519 aa, Unknown
  Obtained from environmental sample
  DOMAIN (60)...(414): Aminotransferase class-III
  misc_feature (1)..(519): Xaa is any amino acid
MFAAEVLPLPPGFRAIAEKPERGKKTMGTQLSNSLVHADISTTLHPYTDARAHEKQGPMIIERGKGIYIYDDAGKEYIEGLAGLWSVAVGFDEPRLVKAAADQMAKLPYYHTFSHKSHEPSIRLAEKIVEMTPEQLTRVFFTSSGSEANDTMIKMVWFMNNALGRPQKKKFLARTRGYHGITVASGSLTGLPNNHRDFDLPAIPVRHLSCPHHYRVGLPGESEAQFAQRLIAEAEAVILEEGPDTIAAFIGEPLMAAGGVMPPPAGYWQGIEALCRKYDILLVADEVICGFGRLGTGFGCEYYGFTPDIMVVSKQLTSSYMPLAAVVFSEAVYNAIADNTAKIGTFGHGFTASGHPVATAVGLENLKIIEERDLIGNAARMGAILQARLAELADHPLVGEVRGAGLIAGLELVADKETRRPFATVGKAGARAFAAGHEHGLIVRAIGDVVALCPPLIINEEQVNETVNRLRKALDDTAKWRADENLNKGELNSKLEGKPIPNPLLGLDSTRTGHHHHHH

SEQ ID NO: 933 - DNA, 1206 bp, Unknown
  Obtained from environmental sample
  misc_feature (1)..(1206): n is a, c, g, or t
atggcgagggtatcgaggaggttccttgaggacagctctagcggcgccaccacaatggcatttgcgcagttggcttccgaggctaaacggaaaccggtgatagacctcaccctaggtcagcccgatgtaacccctccacagactctcgtggagcttctggcgaccgaggctaggggtgtaggagcctcccgctacccgccgccacaaggtctagccgagtatcgcgaggccgtagcatcctacatgcgcgacttttacggtgtcgatgctgagccagagcgtgtcgttgcgcttgcaggtgctaagccgggcatagccgccgccatatactccgtctgtgaccacggcgatgccatgcttgtgctgactccacacttctacgcgtacgtgaacgcggcgcgcatgctaggagtgaagcccgttatggctaggctaaggtgggacggcgggaggcttttcatcgacgaggatgaggtgaagaaggcgtttgaggagcacaagccgtgcctcgttatcgtgaacacaccgcataaccccacgggcctccaccttgatagggagacgctcaagctgataggggatcttgcctcggagcataacacactcgtgctcagcgatgaggtgtactcgtggctcgtgttccgcggtgaacacgtcccgctcctacgcctcctcggcgaagagagagtcatacacctcgagtcgttctcgaagacccttgctatccctggctggcgcgtcggcttcctctacgcgccacgcgaggttgtaaaggcgaccgtcttcttcaattcgaacgtctacactggcatccccaggttcatccagctagccgtagccaagtacatcacagcgtaccgcgaagatatggtcgagtatgtggagagagtgcgtaagctctacgggcggagggcgcgcgtcttcaccgaggccctctcacagctagaggatctcatcgacgtctatgagcccgctgctggcttcttcctattcccgagggtagagcgcctcatagagaagctcggcgtggggagcgcagagaggctcgtagagctgatggccagagaggttggtgtgctggccgtcccgggcaccgtgttcggagaggagtggagaggctacatccgtgttagcctcaccgcgccggagtcaaggcttagggaggcggctgcgaggataggagagctggcaacgcggggggcgtaa

SEQ ID NO: 934 - protein, 401 aa, Unknown
  Obtained from environmental sample
  SIGNAL (1)...(30)
  DOMAIN (31)...(393): Aminotransferase class I and II
  misc_feature (1)..(401): Xaa is any amino acid
MARVSRRFLEDSSSGATTMAFAQLASEAKRKPVIDLTLGQPDVTPPQTLVELLATEARGVGASRYPPPQGLAEYREAVASYMRDFYGVDAEPERVVALAGAKPGIAAAIYSVCDHGDAMLVLTPHFYAYVNAARMLGVKPVMARLRWDGGRLFIDEDEVKKAFEEHKPCLVIVNTPHNPTGLHLDRETLKLIGDLASEHNTLVLSDEVYSWLVFRGEHVPLLRLLGEERVIHLESFSKTLAIPGWRVGFLYAPREVVKATVFFNSNVYTGIPRFIQLAVAKYITAYREDMVEYVERVRKLYGRRARVFTEALSQLEDLIDVYEPAAGFFLFPRVERLIEKLGVGSAERLVELMAREVGVLAVPGTVFGEEWRGYIRVSLTAPESRLREAAARIGELATRGA

SEQ ID NO: 935 - DNA, 1383 bp, Unknown
  Obtained from environmental sample
  misc_feature (1)..(1383): n is a, c, g, or t
atgagcgagcatcgccgcaaccacaatatcgaagaactggtcgagctggacctgcagcatcacctgcatccgttcacggattataagggcctgcgcggcgaaggcggcagccggatcatcacccatgccgagggcgtctatcttttcgacggcaagggcaacaagatcatcgacggcatggccgggctctggtgcgtgaatgtcggttatggccgcaaggaactggccgaggcggcctatcgccagcttctggaacttccttactacaacaccttcttcaagacggcccatccgccctcgatcgagctggcggcgaaggtatcttcgctgttgccggataatttcaattcgatcttcttctccaactctggttcggaggcgaatgacaccaacctgcgcctggtgcaccactattggcgttcagtcggcaagcccggcaaggtgaacatcatcagccgccagaatgcctatcacggctcgaccgtagcgggtgctgcgctgggcggcatgtcgccgatgcaccggcagggcgggcggctcatcccgacgatccatcatgtggcgcagccctattggttcaaggatggcggagatatgacgccggaggaattcggtcgctatgccgcccttcaggtggaagagaagatcaaggagctggggccggagacggtcggcgccttcatcggcgagccgatccagggcgcaggcggggtcattatcccgccggacagctattggcctgagatcaaccggatctgtaaggaatacgatatccttcttatctgtgacgaggtgatttgcggctttggccggacggggaactggttcgggctggaaaccttcgggatcgagccggacctcatcaccatggcgaagggtatgtcgtcgggctatctgccgatttccggctcggccgtgtccgaccgcgtggcggaagggatcgtggaaagcggcggcgaattcttccacggctatacctattccggtcatccggctgcctgtgcggtggcgcttgccaatatcgaaatcatgcagcaggaaaaactggtcgataaggtcaggaacgagaccggcccgtatctggcgcagaaacttgccgaattggcagaccatccgttgatcggtgaggtgcgttcgtccggtcttgtcggcgcgctggagctggtgaaggacaaggaaacccggacccggttcaagcccgacggtaaagcgggcacggtctgtcgggatcatttcttcaagcgcaatgcgatcatgcgcgcctgtggggatacaatggttctgtccccgccgctgacgattacgaaggcggaactggatgcgctgttcgctgttgcgcatgaggcggtggatgccaccgcaaaggatatggggcttttgtga

SEQ ID NO: 936 - protein, 460 aa, Unknown
  Obtained from environmental sample
  DOMAIN (39)...(390): Aminotransferase class-III
  misc_feature (1)..(460): Xaa is any amino acid
MSEHRRNHNIEELVELDLQHHLHPFTDYKGLRGEGGSRIITHAEGVYLFDGKGNKIIDGMAGLWCVNVGYGRKELAEAAYRQLLELPYYNTFFKTAHPPSIELAAKVSSLLPDNFNSIFFSNSGSEANDTNLRLVHHYWRSVGKPGKVNIISRQNAYHGSTVAGAALGGMSPMHRQGGRLIPTIHHVAQPYWFKDGGDMTPEEFGRYAALQVEEKIKELGPETVGAFIGEPIQGAGGVIIPPDSYWPEINRICKEYDILLICDEVICGFGRTGNWFGLETFGIEPDLITMAKGMSSGYLPISGSAVSDRVAEGIVESGGEFFHGYTYSGHPAACAVALANIEIMQQEKLVDKVRNETGPYLAQKLAELADHPLIGEVRSSGLVGALELVKDKETRTRFKPDGKAGTVCRDHFFKRNAIMRACGDTMVLSPPLTITKAELDALFAVAHEAVDATAKDMGLL

SEQ ID NO: 937 - DNA, 855 bp, Unknown; identical to SEQ ID NO: 3
  Obtained from environmental sample
  misc_feature (1)..(855): n is a, c, g, or t

SEQ ID NO: 938 - protein, 284 aa, Unknown; identical to SEQ ID NO: 4
  Obtained from environmental sample
  DOMAIN (7)...(276): Aminotransferase class IV
  misc_feature (1)..(284): Xaa is any amino acid

SEQ ID NO: 939 - DNA, 855 bp, Unknown
  Obtained from environmental sample
  misc_feature (1)..(855): n is a, c, g, or t
atgtcccgtattgcttatgttaacggtgcttatgttccccacgatgaggctgtggtctcgatcgatgatcgcggctatcagtttgctgatgctgtgtatgaaggtgtgactgtgcgcaaaggccgcatgatagaccttgaaccacacatggacaggctcgcgcgctcgatgcgggagcttgcgatggcagcaccgatggagcgcgcgcccatgcgctttgtgttcagggaggttatccggcgcaaccgtataagcgatggatttctctatatacaaatcagccgcggcgtagcccgacgcgaccatgccttccccaccacacccacggcaccgagccttgttgtaacctgcaaacgcctgagtgttgacggtgtttttgcccgcgcagccaagggtgtgaaggccttttcggaaagtgatatccgctggggtcggtgcgatatcaaatccacgtccctgctcccgaacatcctcgcgaaacaggccgccaaggaaaaaggcggctttgaggccgtgcttgtagaccgggacggttatgtaaccgaaggcagcagcaccaacatgtggatggtacgcaccgacggcacgctggtgacccgctcaacggatgataacattctgcccggcattacccgtgcgacgattaaaaagctggcggaagagttgcagatcaaggtggagacaaaagccttcacgctggaagacgccaaagcaggcgcggagatgttcctctcaagctcgactggctgcgccatgccgattgtggagctggacggccataagattggcgacggaacacccggtcccgtcgccagacgattgattgaagcttaccggacttacatggaggcctaa

SEQ ID NO: 940 - protein, 284 aa, Unknown; identical to SEQ ID NO: 6
  Obtained from environmental sample
  DOMAIN (8)...(279): Aminotransferase class IV
  misc_feature (1)..(284): Xaa is any amino acid

SEQ ID NO: 941 - DNA, 879 bp, Unknown
  Obtained from environmental sample
  misc_feature (1)..(879): n is a, c, g, or t
atggttcgtacggtctatgtaaacggatattatgcgccgtatgagcatgccgtcgtgcatgtcgaggatcggggctatcaattcgcagatgccgcctatgaggtttgcgaagtacgcggcggagcgctgatcgatgagcgcctgcatatggaacggctgcgccggtcgctgggcgagctcagaattgattttcccatgaccatgcgctccctcagcgtgatcctgcacgagacggtgcgccggaaccgggtccgcgacggctccgtctatctccaggtaagccgcggcgtcgccccgcgcgactttgccttcccggacccatccgcgaggccgagcgtggtctgctatgccaaggcgaagccggctgccgcattggagcgccgggcggccaagggcatccgcgtcgtcaccatgccggatatccgctggcgccggccggacatcaaatcggtctcgctgctgcccaatgtgctggcgcggcaggcagcccacgatgtcggagccgacgaagcctggctggtcgacgacaacggctttgtcaccgaaggcgccgcctgcaacgcctggatcctgatcgaggacgatacgctcgtcacccggccggccgaaatggccattttgcgcggcgtcacccgcaccgttctgctgcaggcaattgccgaggcacagctcaaggttgttgagcggccgttcagcgtcgaagaggcaaaaagggccaaggaggccttcataacgtcggcaacgtcgatcataacgccggtgatcgcgataaacggtgtgcccctgggcgacggcaagcccggaccggtagcaatgaagctgcgccggctcttccgggggtcggccgagaaatcaggagccggaacgttgttggaataa

SEQ ID NO: 942 - protein, 292 aa, Unknown; identical to SEQ ID NO: 12
  Obtained from environmental sample
  DOMAIN (8)...(279): Aminotransferase class IV
  misc_feature (1)..(292): Xaa is any amino acid

SEQ ID NO: 943 - DNA, 870 bp, Unknown
  Obtained from environmental sample
  misc_feature (1)..(870): n is a, c, g, or t
atggtttttctgaacgggcagttcgtcgcgttgggggacgccaaggtctccgtgctcgaccgcggcttcatcttcggcgacggcgtctacgaggtcgtgccggtgtactcgcgcgtgccgttccgcctcgacgagcacctcgtgcgactcgagcgcagtctcgccgcggtcgccatccgcaatccgtacagccgcgccgagtggcgcggcttcatcaccgagctggtggcacgccaggacttcgaggaccagggggtctatttccaggttacgcgcggcgtggccaagcgcgaccatgccttcccgaagaacgccgagccgacggttttcatgatggcaagcccgctcgtcaacccgccgcgcgagcaagtggaaaacggcgcgcccgcggtgagcgcgcgcgacaatcgctggctgcgctgcgacatcaagtcgatctcgctcatcggcaacgtgctgctgcgccagctctcggcgcaagtcgacgcggccgagacgatccttttccgcgatggcaagcttaccgaggcctccgcgtcgaacgtgttcattgtgaagttcggcgtcgtcgccgggccgccgaagagctcactcatcctccccggaatcacctacgacgtgatcgtcgagcttgcgcaggctgccggcatcccgctggagctgcgcgaggtaacggaggccgaggtacgcagcgccgacgagctgtgggtgacctcgtcgtccaaggaagtgctcgccatcgtgcacctcgatggcgcgtcgattggcgacgggcggcccggcccggcgttccgccagatgtaccgcctctaccaggatttcaagcagaaggtcatgcgcgcgggccggcgccagtcggtctcggcctaa

SEQ ID NO: 944 - protein, 289 aa, Unknown; identical to SEQ ID NO: 8
  Obtained from environmental sample
  DOMAIN (5)...(272): Aminotransferase class IV
  misc_feature (1)..(289): Xaa is any amino acid

SEQ ID NO: 945 - DNA, 855 bp, Unknown
  Obtained from environmental sample
  misc_feature (1)..(855): n is a, c, g, or t
atgaacgcactaggatattacaacggaaaatggggtcctcttgacgaaatgaccgtgccgatgaacgacaggggctgcttctttggagacggcgtgtacgacgctacctgcgccgctaacggggtgatttttgccctggatgagcacattgacaggtttttcaacagcgcaaaactcctggaaatagaaatcggttttacaaaagaggaactgaaaaaaaccatcaatgaaatgtactccaaagtggataagggggagtaccaggtttattggcaggcgactcgtggaaccggccggcgaagccatgtatttccggcaggtccctcaaatctctggataatgattaagcctaatcacgtcgacgatctttatagaaaaataaagctcattaccacggaagatacccgctttttccactgcaacatcaaaacacttaaccttattcccaatgtcattgcttcccagcgagcgctggaagcgggctgccacgaggcagtttttcaccggggcgaaacagtgaccgaatgcgcccatagcaatgtccacataattaaggacggcaggtttattactcatcaaactgacaacctgatcctccctggcatagcccgcagccatttgttgcaagcctgcgacaggctgaatgttccggttgacgaacgggaatttaccctttcggaattgttcggcgcggatgaggtacttgtgtccagcagcggcacactcggtcttagcgccgatacaatagacggaaaaaatgtgggagggaaagcgccggaactgctaaaaagaattcaggacgaagtgttgaaggaatttatcgaagcgacagctcgtgccgaattctttggataa

SEQ ID NO: 946 - protein, 284 aa, Unknown; identical to SEQ ID NO: 14
  Obtained from environmental sample
  DOMAIN (8)...(270): Aminotransferase class IV
  misc_feature (1)..(284): Xaa is any amino acid

SEQ ID NO: 947 - DNA, 837 bp, Unknown
  Obtained from environmental sample
  misc_feature (1)..(837): n is a, c, g, or t
atgcgcgaaattgtttttttgaatggggaatttcttgaaaaagaagcggctaaaatttctcccaatgataggggttttatttttgccgatggtgtttacgaagttgccaaatattacaatggacgcccttttcggtatgatgaccacttaaaaaggctggaacgcagtctttctgaacttgaaattgaatacccggatattgaaaatcttcaatcggtttttaactcactcataaccagaaataatcttaatgataaacacgcaggggtatatttgcaaattacacgcggagaacataaacgtgtgcatcatttccctgaaaatgttcagccaactgtttatgcttttgctttcgaattgccttccttcaaggaaaatcttgagaaaggaatcaaagtaattactcacgaagatattcgctggcaacgttgtgatattaaatcggtttcactgcttcccaatacaatgctgtataacaaagccgtaaatgccggggcgggagagtgcgttttaattcgcaatggaatggttaccgaagctacacattcaagcgttttgtgtgtaaaagacggaattgttattacacgaccactatcaaatctgattcttcccggaattacaagaaaagttgtacaggagatatgctctgtccataatattgcttttgaagagcgcgaattttctgaaactgaattgcttgaaatggatgaaattataattgctggtacggggagcgaaataactccggcaatacaagtaaacgaaacaacgattggaaatggctcaccaggcaaaatcacacggtttattcagcaaaagttttttgagatggtttag

SEQ ID NO: 948 - protein, 278 aa, Unknown; identical to SEQ ID NO: 16
  Obtained from environmental sample
  DOMAIN (8)...(275): Aminotransferase class IV
  misc_feature (1)..(278): Xaa is any amino acid

SEQ ID NO: 949 - DNA, 918 bp, Unknown
  Obtained from environmental sample
  misc_feature (1)..(918): n is a, c, g, or t
atgttggatgaacggatggtgttcattaacggcgactttgtaaagtggcaggacgcaacggtccacatgatgagccacagcttcgcgcgcggctcggccattttcgaagtcatcagcttttacgcgacgggctcgggtccggctgttttccggctggacgatcacatcgcgcgtttggaaaaatcggcaagcttcctgggcatggagcttcccctgagccacgaggcactgtgccgggccgtggcggacaccgtgcgccgcaaccgcctcggtcggggcgtcatcaaggtgatcggctactacccccagttcgcgctcgacattcagccgccgcagaagcgtctggatgttgcggtctttgcgctggagccggcgcaggacctgaaggactttgagttttcctttgaaaagggcaccagtgcaggcatcgcgcgctggcgcaaactcgaccccgagacggtccccatcgaggccaaggccgccgccaactacctgaacgggatgatcgccagccaggatgtccggaaacgagggttcgaggatgccatcctgctggacacccagggattcatcgccgagggcgccaccgaatccgtttttctggtcaaagacggcaagctgctgacgccctgcctggggaccgtgctcgacagcatcacccgccggtccattttgcaggtcgcgcgccatctcgggatcgaaacgatcgaaggccgtctgcggccggcgctgctcttcgaagccgatgaggtctttttcgccaacacccccttcaaggtgatccccgtccgtcgcatcgaggagcgccggatgtcggccactcccggcccgatgcagcgcaggttgtgggatgttttgcagaagatcgccgccggccaagagcctgacttcgccgagtggctctatgccgtggactag

SEQ ID NO: 950 - protein, 305 aa, Unknown; identical to SEQ ID NO: 18
  Obtained from environmental sample
  DOMAIN (10)...(287): Aminotransferase class IV
  misc_feature (1)..(305): Xaa is any amino acid

SEQ ID NO: 951 - DNA, 1206 bp, Pyrolobus fumarius
gtggcgagggtatcgaggaggttccttgaggacagctctagcggcgccaccacaatggcatttgcgcagttggcttccgaggctaaacggaaaccggtgatagacctcaccctaggtcagcccgatgtaacccctccacagactctcgtggagcttctggcgaccgaggctaggggtgtaggagcctcccgctacccgccgccacaaggtctagccgagtatcgcgaggccgtagcatcctacatgcgcgacttttacggtgtcgatgctgagccagagcgtgtcgttgcgcttgcaggtgctaagccgggcatagccgccgccatatactccgtctgtgaccacggcgatgccatgcttgtgctgactccacacttctacgcgtacgtgaacgcggcgcgcatgctaggagtgaagcccgttatggctaggctaaggtgggacggcgggaggcttttcatcgacgaggatgaggtgaagaaggcgtttgaggagcacaagccgtgcctcgttatcgtgaacacaccgcataaccccacgggcctccaccttgatagggagacgctcaagctgataggggatcttgcctcggagcataacacactcgtgctcagcgatgaggtgtactcgtggctcgtgttccgcggtgaacacgtcccgctcctacgcctcctcggcgaagagagagtcatacacctcgagtcgttctcgaagacccttgctatccctggctggcgcgtcggcttcctctacgcgccacgcgaggttgtaaaggcgaccgtcttcttcaattcgaacgtctacactggcatccccaggttcatccagctagccgtagccaagtacatcacagcgtaccgcgaagatatggtcgagtatgtggagagagtgcgtaagctctacgggcggagggcgcgcgtcttcaccgaggccctctcacagctagaggatctcatcgacgtctatgagcccgctgctggcttcttcctattcccgagggtagagcgcctcatagagaagctcggcgtggggagcgcagagaggctcgtagagctgatggccagagaggttggtgtgctggccgtcccgggcaccgtgttcggagaggagtggagaggctacatccgtgttagcctcaccgcgccggagtcaaggcttagggaggcggctgcgaggataggagagctggcaacgcggggggcgtga

SEQ ID NO: 952 - protein, 401 aa, Pyrolobus fumarius; identical to SEQ ID NO: 934
  DOMAIN (31)...(393): Aminotransferase class I and II
  SITE (238)...(251): Aminotransferases class-I pyridoxal-phosphate attachment site. Prosite id = PS00105

SEQ ID NO: 953 - DNA, 1185 bp, Aquifex aeolicus; identical to SEQ ID NO: 927

SEQ ID NO: 954 - protein, 394 aa, Aquifex aeolicus; identical to SEQ ID NO: 928
  DOMAIN (32)...(387): Aminotransferase class I and II
  SITE (34)...(59): Sugar transport proteins signature 2. Prosite id = PS00217
  SITE (232)...(235): N-glycosylation site. Prosite id = PS00001
  SITE (275)...(278): N-glycosylation site. Prosite id = PS00001

SEQ ID NO: 955 - DNA, 879 bp, Unknown
  Obtained from environmental sample
gtggcgtgggtcgatggcgaacttgttccgcttcacgaggcccgcattccgcttctcgatcagggtttcctgcactccgatctgacctatgacgtccccgccgtctgggatggcaggttttttcgccttgatgaccatctcgatcgatttgaggcgagctgcgcgaaactgaagctgaaaagcccgatggatcgcgaaaccatgaaggcaacgcttgtcgagatggtcgccaaaagcggcattcgtgatgcctatgtggaaatgattgtcacgcgtggcctgaaattcgtacgcggcaacaaacccgaggacatcgtaaattcgctttacatgctggtcatgccctatgtgtgggtgatgtcaccggagatacagcgtgttggcggcagtgctgtcatcacccgcacggtgcgccgtgttccgccgggcgccatcaacccaacgatcaagaatctgcaatggggtgatttcgtgcgcggtctgatggaagcgcaggatcgcggcgccatttacccgatccttcccgatggtgacggtaacatcaccgaaggctccggtttcaatgtgttcctggtcaagaatggcgtgctttacacaccggaccgtggcgttctggaaggtgtgacgcgaaaaaccgtgttcgatatcgccgctgccaagggctggaaggttgcccttgaacatgtgccggttgaacttgcctatcatgccgacgaaatatttttctgcacgacggcgggcggcatcatgccggtcacaacattggatggagaacttgttggcggcggacaggttggcccggtcacccgcgcgatctgggacgaatattggaagctgcattacacagcagatttgagttttgcgatcgactatccctga

SEQ ID NO: 956 - protein, 292 aa, Unknown
  Obtained from environmental sample
  DOMAIN (5)...(277): Aminotransferase class IV
  SITE (182)...(185): N-glycosylation site. Prosite id = PS00001
MAWVDGELVPLHEARIPLLDQGFLHSDLTYDVPAVWDGRFFRLDDHLDRFEASCAKLKLKSPMDRETMKATLVEMVAKSGIRDAYVEMIVTRGLKFVRGNKPEDIVNSLYMLVMPYVWVMSPEIQRVGGSAVITRTVRRVPPGAINPTIKNLQWGDFVRGLMEAQDRGAIYPILPDGDGNITEGSGFNVFLVKNGVLYTPDRGVLEGVTRKTVFDIAAAKGWKVALEHVPVELAYHADEIFFCTTAGGIMPVTTLDGELVGGGQVGPVTRAIWDEYWKLHYTADLSFAIDYP

SEQ ID NO: 957 - DNA, 1386 bp, Unknown
  Obtained from environmental sample
atgggcacgcagctctcaaactctcttgtccatgcggacatctcgaccacccttcatccctacaccgacgcccgtgcgcatgaaaagcagggcccgatgatcatcgagcgcggcaagggcatctacatctatgacgacgccggcaaggaatatatcgaaggtctcgccggtctctggtcggtcgccgtcggttttgacgagccgcgccttgtaaaggctgccgccgaccagatggccaagctgccctactatcataccttcagccacaagtcgcacgagccctccatccggctggccgagaagatcgtggaaatgacgcccgagcagctgacgcgcgtcttcttcaccagctcgggatcggaagccaacgacaccatgatcaagatggtgtggttcatgaacaatgcgctgggccgcccgcagaagaagaagttcctcgcccgcacccgcggctatcacggtatcacggtggcatccggcagtctcacgggcctgccgaacaatcatcgcgatttcgacctgccggccatcccggtccgtcacctgagctgcccgcaccactatcgcgtcggcctgcccggagaatccgaggcgcagttcgcgcagcgcctgattgccgaggccgaagccgtgatcctcgaagaaggcccggacacgattgccgccttcatcggcgagccgctgatggctgcaggtggtgtcatgcctccgccggccggttactggcagggcatcgaggcgctgtgccgcaagtatgacatcctgcttgtcgccgacgaagtgatctgcggcttcggtcgtctcggaaccgggttcggctgcgaatactacggcttcacaccggacatcatggtcgtctccaagcagctgacctcgtcctatatgccgcttgcggccgttgtcttcagcgaggcggtctacaacgccatcgccgacaacacggccaagatcggcacgttcggccatggcttcaccgcctccggccatccggttgccaccgccgttggtctggaaaacctcaagatcatcgaagagcgcgatctgatcggcaacgccgcccgcatgggcgccattctccaggcacgtctggcggaactggcggatcacccgctggtgggcgaagtgcgcggcgccggcctcatcgccggtctcgagctggtcgccgacaaggaaacgcgccgccccttcgccacggtcggcaaggcgggtgcccgcgcgttcgcagccggacatgagcatggcctcatcgtgcgcgccatcggcgacgtcgtcgcgctctgcccaccgctcatcatcaatgaggagcaggtgaacgaaacggtgaaccgcctgcgcaaggcgctcgacgacacggccaagtggcgtgctgacgagaacctgaactaa

SEQ ID NO: 958 - protein, 461 aa, Unknown
  Obtained from environmental sample
  DOMAIN (34)...(388): Aminotransferase class-III
  SITE (124)...(127): N-glycosylation site. Prosite id = PS00001
  SITE (444)...(447): N-glycosylation site. Prosite id = PS00001
MGTQLSNSLVHADISTTLHPYTDARAHEKQGPMIIERGKGIYIYDDAGKEYIEGLAGLWSVAVGFDEPRLVKAAADQMAKLPYYHTFSHKSHEPSIRLAEKIVEMTPEQLTRVFFTSSGSEANDTMIKMVWFMNNALGRPQKKKFLARTRGYHGITVASGSLTGLPNNHRDFDLPAIPVRHLSCPHHYRVGLPGESEAQFAQRLIAEAEAVILEEGPDTIAAFIGEPLMAAGGVMPPPAGYWQGIEALCRKYDILLVADEVICGFGRLGTGFGCEYYGFTPDIMVVSKQLTSSYMPLAAVVFSEAVYNAIADNTAKIGTFGHGFTASGHPVATAVGLENLKIIEERDLIGNAARMGAILQARLAELADHPLVGEVRGAGLIAGLELVADKETRRPFATVGKAGARAFAAGHEHGLIVRAIGDVVALCPPLIINEEQVNETVNRLRKALDDTAKWRADENLN

SEQ ID NO: 959 - DNA, 1383 bp, Unknown; identical to SEQ ID NO: 935
  Obtained from environmental sample

SEQ ID NO: 960 - protein, 460 aa, Unknown; identical to SEQ ID NO: 936
  Obtained from environmental sample
  DOMAIN (39)...(390): Aminotransferase class-III
  SITE (129)...(132): N-glycosylation site. Prosite id = PS00001
  SITE (160)...(170): Serine proteases, subtilase family, histidine active site. Prosite id = PS00137
  SITE (360)...(363): N-glycosylation site. Prosite id = PS00001

SEQ ID NO: 961 - DNA, 1260 bp, Unknown
  Obtained from an evironmental sample
atgacgggccgaaccgcggacgggacggtgatcgtcgtcggtgcggggatcgtcgggatcgcctgtgcgcactacctgcgcgaggcgggactcacggtgacggtgatcgaccgggggacgatcgcaggcgcgtgctcgcatgccaactgcggtctgatctgtcccagccacctgttgccgctgacgcatccgggcgctgttcgtgccgcgttgaagtcgttgttcacgccgcacgctccgtttcggatccagccacggctgagtccggcgctgtggtcgtggctgtggcacttcgcccgccggtgcaatcaccgtcagatgctgaccgccgcggggcatctcaaggcgatcctcgaatcgtctatggttgagtatcggcgactggttcccgcgcagcccctcgagtgcgaatggaaggagagtggactgctgaacgtgctcttgaccgaccgtggcatgcacgcgttcgccgaggaggaccggctgatcagcgagcacttcggcctgtccgcacggcggatcgaggggagcgaactgccggcgttcgacccggccctcaagccgggcctggcgggggcgttctactacgagggggacgcttcgctccgccccgaccgcttgaacgcaagctgggccgcgcggttgcgggagcggggagtaaggttcctcgagcagtgcgagatgcagcggatcgtcacttcgggaggacggattacgacgctgcagacgctgcagggagagatggccgcgcagttcgtcgtcatcgcgacgggtgcctggagctgccggctggcgcgcgacctcggctgccggattccggtgcagcccggcaaagggtactcggtgacgatggcccggcccgagccctgtccgaggtttccgatgctgttccccgagcaccgcgtcgccgtctcgccattcgaacaggggtatcgcctcggttcgatgatggagttcgccggcttcgatacgtcgattcgaccgcagcggatcgagcagttacgaacatcggcagagccctacctggtggcaccttacaccgaagtcgagcacgaacgatggtacggctggcggccgatgacgtgcgacagcctgccgatcatcggccgggtgcccgctctggagaacgcgtacctggcgaccggccacaacatgctgggtgtcagtctcgcccctgcgaccggccgactcatcgccgagatcgtcaccggcgtgccgccgcatgtcgacccggcaccctacagtgcaaaccggttctag

SEQ ID NO: 962 - protein, 419 aa, Unknown; identical to SEQ ID NO: 254
  Obtained from an environmental sample

SEQ ID NO: 963 - DNA, 1260 bp, Unknown; identical to SEQ ID NO: 961
  Obtained from an environmental sample

SEQ ID NO: 964 - protein, 419 aa, Unknown; identical to SEQ ID NO: 254
  Obtained from an environmental sample

SEQ ID NO: 965 - DNA, 2267 bp, Unknown
  Obtained from an environmental sample
atgggaactgtttcgaacgtggtgggacaactggccgggagcgaaggcgtgagcggcaccacaggcatccgcgtgatcgactcgcacaccgagggtgagccgacgcgcgtcgtcatcgacggcggcccggatcttggagagggaactctctcggaaaggcgggagcggttccgccggtcgtttgacgacttccgccgtgcggtgatcctcgagccgcgcggctcggatgtgctggtcggggcgctgctgtgcgaaccggtcgatccctcgtgtgcagcgggggtgatcttcttcaacaacaccggctacctggggatgtgcggtcacggcgcgatgggggtggcagcgactttggcgcatctcggccggatcaacttcggcaggcatcgtctggagacgcctgtcggcgtcgtcgaggttgagttgcacgatccgcatcgcgtgagcgttgagaacgtgccgagctatcgctggcggagcggcgtctgcttcgaggtcgagtcgctggggaccgtcaccggcgatgtcgcgtggggcggcaactggttcttcctggtggagggttcgccgctgccgctccttccggagaacgcccgctcgctgacggacgccgctcagcagatcaggcaggcattgatcgcaaacgggatcgccggtgaggatggtgccgagatcgaccacatcgagctgttcgggccggcaggcgcccccgatgctcacggccgcaacttcgtgctctgtcccggcggtgcgtgggatcgctctccctgcgggaccgggacgagcgcgaagctggcctgcctggccgccgacggaaaactcgcacccgggcaggtgtgggtgcaggagagcctgatcggcagccggttctgggcgtcgtatcgtgaggcgtcggacgggaagatcatcccccgcatcaccggccgggcgtatgtgtgcggcgaggcgaccctgtttcgacatcccgatgacccgttccgtgacggaatctccatcgagggggcttcatgacgggccgaaccgcggacgggacggtgatcgtcgtcggtgcggggatcgtcgggatcgcctgtgcgcactacctgcgcgaggcgggactcacggtgacggtgatcgaccgggggacgatcgcaggcgcgtgctcgcatgccaactgcggtctgatctgtcccagccacctgttgccgctgacgcatccgggcgctgttcgtgccgcgttgaagtcgttgttcacgccgcacgctccgtttcggatccagccacggctgagtccggcgctgtggtcgtggctgtggcacttcgcccgccggtgcaatcaccgtcagatgctgaccgccgcggggcatctcaaggcgatcctcgaatcgtctatggttgagtatcggcgactggttcccgcgcagcccctcgagtgcgaatggaaggagagtggactgctgaacgtgctcttgaccgaccgtggcatgcacgcgttcgccgaggaggaccggctgatcagcgagcacttcggcctgtccgcacggcggatcgaggggagcgaactgccggcgttcgacccggccctcaagccgggcctggcgggggcgttctactacgagggggacgcttcgctccgccccgaccgcttgaacgcaagctgggccgcgcggttgcgggagcggggagtaaggttcctcgagcagtgcgagatgcagcggatcgtcacttcgggaggacggattacgacgctgcagacgctgcagggagagatggccgcgcagttcgtcgtcatcgcgacgggtgcctggagctgccggctggcgcgcgacctcggctgccggattccggtgcagcccggcaaagggtactcggtgacgatggcccggcccgagccctgtccgaggtttccgatgctgttccccgagcaccgcgtcgccgtctcgccattcgaacaggggtatcgcctcggttcgatgatggagttcgccggcttcgatacgtcgattcgaccgcagcggatcgagcagttacgaacatcggcagagccctacctggtggcaccttacaccgaagtcgagcacgaacgatggtacggctggcggccgatgacgtgcgacagcctgccgatcatcggccgggtgcccgctctggagaacgcgtacctggcgaccggccacaacatgctgggtgtcagtctcgcccctgcgaccggccgactcatcgccgagatcgtcaccggcgtgccgccgcatgtcgacccggcaccctacagtgcaaaccggttctag

SEQ ID NO: 966 - protein, 738 aa, Unknown
  Obtained from an environmental sample
MGTVSNVVGQLAGSEGVSGTTGIRVIDSHTEGEPTRVVIDGGPDLGEGTLSERRERFRRSFDDFRRAVILEPRGSDVLVGALLCEPVDPSCAAGVIFFNNTGYLGMCGHGAMGVAATLAHLGRINFGRHRLETPVGVVEVELHDPHRVSVENVPSYRWRSGVCFEVESLGTVTGDVAWGGNWFFLVEGSPLPLLPENARSLTDAAQQIRQALIANGIAGEDGAEIDHIELFGPAGAPDAHGRNFVLCPGGAWDRSPCGTGTSAKLACLAADGKLAPGQVWVQESLIGSRFWASYREASDGKIIPRITGRAYVCGEATLFRHPDDPFRDGISIEGASRAEPRTGRSSSVRGSSGSPVRTTCARRDSRRSTGGRSQARARMPTAVSVPATCCRRIRALFVPRSRCSRRTLRFGSSHGVRRCGRGCGTSPAGAITVRCPPRGISRRSSNRLWLSIGDWFPRSPSSANGRRVDCTCSPTVACTRSPRRTGSASTSACPHGGSRGANCRRSTRPSSRAWRGRSTTRGTLRSAPTATQAGPRGCGSGEGSSSSARCSGSSLREDGLRRCRRCRERWPRSSSSSRRVPGAAGWRATSAAGFRCSPAKGTRRWPGPSPVRGFRCCSPSTASPSRHSNRGIASVRWSSPASIRRFDRSGSSSYEHRQSPTWWHLTPKSSTNDGTAGGRRATACRSSAGCPLWRTRTWRPATTCWVSVSPLRPADSSPRSSPACRRMSTRHPTVQTGS

SEQ ID NO: 967 - DNA, 2267 bp, Unknown; identical to SEQ ID NO: 965
  Obtained from an environmental sample

SEQ ID NO: 968 - protein, 738 aa, Unknown; identical to SEQ ID NO: 966
  Obtained from an environmental sample

SEQ ID NO: 969 - DNA, 852 bp, Unknown
  Obtained from an environmental sample
atggcaaagattttatggaatgatcaaatcgtagaagaaaaagaagtgaaaattggttttgaagaccgtgggtatcaatttggtgatggagtatatgaagtagtcaaaatttataatggtgatttgtttacggcaaaggaacatatagatcgcctgtatgcaagtgctgacaaaattcaaatagtcataccctttacaaaagataagctacatcaattaatgcacgaattaattgaaacgaacgaggttaagaacggtcagatttatttacagatcacacgaggggacagtccacgagttcataacttccctaatccagcagtgaactctgtactaaccgcttatactaaagaaacaaaacgtccactggcacagcaggaaagtggtatcaaagcttgttttgtagaggatattcgatggttaagatgtgatataaaatcactaaacctacttggtaacgtgcttgcaaaacaagaagcagttactaaaggttgctttgaagccattttacatcgtggggaaactattacagaaggttcttcctctaatatgtacggcattaaagatggtgttttgtatacacatccgattagtaacctaattttaaatggtattactagaaaagtgctgttagattgctgtgaggaaataggacttaaggtagttgaagaggcgtttacgaaagaagaggcgctaaacatggacgaatttatcatgtcatcaactagcgctgaggtaatgccggttatatccatcgatgggaatgttattggggacggaaaacctggagagtttacaagaaagcttcagaaagcctttgaacaaaaaattccatccactttaaatgtatag

SEQ ID NO: 970 - protein, 283 aa, Unknown; identical to SEQ ID NO: 34
  Obtained from an environmental sample

SEQ ID NO: 971 - DNA, 1077 bp, Unknown
  Obtained from an environmental sample
atgccgaagcatcgcaaggctcgcttgcgtcgccaagggctggcggctaagcacggcccgacttttcgcacttcggagcctgccttgaccggtcaagtgaataccaagccccgcggccgccagttcttcaacaatccgggtccgaccaacattcccgaccgcatcctgcgggcgatggaccggccggtgatggacttcctcgcccccgaattcctcgagatgcaccgcgcctgctacgccggcatgaagcgcatcttcaagaccgaccaggaaatctacttccatgcctcgaccggccacggcgcctgggaagcggcggtcgccaacctgttctcgcccggcgacctcgtgctggtgatcgagaccggctacttctcgctgggcttcaaggagctcgccgagacgctcggcctgaaggtcgaggtggtcggcgccgactggcgcaagggcctcgagttcgcgaagctcaccgagcgcctcgccgccgacaagggccacgagatcaaggccgtgctcgccgtgcacaacgagaccgcgaccggcatggtgctgccgctcgccgaggtccgccgcgcgatggaccagaccaagcatccggcgctgctgctcagcgacaccatctcctcgctcggcagcatggaatacaagatggatgcctggggcatcgacgtcaccatcgccggcagccagaagggcctgatgctgccgaccggcatggcgatcaccggcgtcagcaagaaggcgctcgaggcctcgcgcaaggccaagctgcccaagtactacttcaactgggagctgatggagcagcgcaagccgcagcgcttcatcgggaccgtgccggtccatttcttcttcggcctgaccgagtcgatcaagatgatcgaggaggagacgctggaaggcgtgttctcccgccacgcccggctcggcgaggcgacccgcgccgcggtgcgcgcctggggcaaggacggcaagggcccgtcgctgttcggccagaccgaggaccgtctctccaactcggtcaccacggtgatgatgcccgagggccacacctccgacgccctcgtgccgaattag

SEQ ID NO: 972 - protein, 358 aa, Unknown
  Obtained from an environmental sample
MPKHRKARLRRQGLAAKHGPTFRTSEPALTGQVNTKPRGRQFFNNPGPTNIPDRILRAMDRPVMDFLAPEFLEMHRACYAGMKRIFKTDQEIYFHASTGHGAWEAAVANLFSPGDLVLVIETGYFSLGFKELAETLGLKVEVVGADWRKGLEFAKLTERLAADKGHEIKAVLAVHNETATGMVLPLAEVRRAMDQTKHPALLLSDTISSLGSMEYKMDAWGIDVTIAGSQKGLMLPTGMAITGVSKKALEASRKAKLPKYYFNWELMEQRKPQRFIGTVPVHFFFGLTESIKMIEEETLEGVFSRHARLGEATRAAVRAWGKDGKGPSLFGQTEDRLSNSVTTVMMPEGHTSDALVPN

SEQ ID NO: 973 - DNA, 861 bp, Unknown
  Obtained from an environmental sample
atggacgcactgggatattacaacggaaattgggggcctctggacgagatgactgtgccgatgaacgacaggggctgctactttggagacggcgtatacgacgctacctgcgccgttaacggagttatttttgccctggatgagcacattgacaggtttttcaacagcgcaaagctcctggaaataaatattagcttaacaaaagaggaattgaaaaaaactttaaatgaaatgtactccaaagtggataaaggagagtacctggtttattggcaggtgactcgcggaacaggccggcgaagccatgtatttccggcaggcccttcaaatctctggattataattaagcccaatcacatcgacaatctttatagaaaaatcaagctcattaccatggatgatacccgcttcctacactgcaacatcaagacccttaaccttatacccaatgtcattgcttcccagcgggcgctggaagcgggttgccacgaggcggtatttcaccggggcgaaacggtaaccgagtgcgctcacagcaatgtccatatcattaaaaacggcaggtttattacccatccggcggacaacctgatcctccggggtacagcccgcagtcatttattgcaggcctgtgtcaggcttaacattccggtagacgaacgggaattttccctttcggaattattcgacgcggacgaggtgcttgtgtccagcagcggcacactcggccttagcgccgaagaaatcgacggaaaaaaagcgggagggaaagcgcctgaactgctaaaaaaaatccaggatgaagtgctgagggaatttatcgaagcgacaggctacacgcctgagtggagcagggtataa

SEQ ID NO: 974 - protein, 286 aa, Unknown; identical to SEQ ID NO: 220
  Obtained from an environmental sample

SEQ ID NO: 975 - DNA, 879 bp, Unknown
  Obtained from an environmental sample
atggcgtgggtcgatggcgaactcgttccgcttcacgaggcccgcattccgcttcttgatcagggtttcctgcattccgatctgacctatgacgtacccgccgtttgggatggcaggtttttccgccttgatgatcacctcgatcgatttgaggtgagctgcgcgaaactgaagctgaaaagcccgatggatcgcgaaaccatgaaggcaacacttgtcgagatggtggcgaaaagcggcatccgtgatgcctatgtggaaatgatcgtcacacgaggtctgaaattcgtgcgcggcaacaaacccgaagacatcgtgaattcgctttacatgctggtcatgccctatgtgtgggtgatgtcaccggaaatacagcgtgttggcggcagtgcggtgatcacccgcacggtgcgtcgtgttcccccgggcgccatcgacccgacgatcaagaacctgcaatggggtgatttcgtgcgcggtctgatggaagcgcaggatcgcggtgccatttacccgatccttcccgatggtgacggcaacatcaccgaaggctccggcttcaatgtgttcctggtcaagaatggcgtgctttacacaccggaccgtggcgttctggaaggtgtgacacgaaagaccgtgttcgatatcgccgccgtcaagggctggaaggttgcccttgaacatgtgccggttgaacttgcctatcatgccgacgaaatctttttctgcacgacggcaggcggcatcatgccggtcacgacgctggatggagaacttgttggcggcggacaggttggcccggtcactcgcgctatttgggacgaatactggaagctgcattacacagaagatttgagttttgcggtggattatccctaa

SEQ ID NO: 976 - protein, 292 aa, Unknown; identical to SEQ ID NO: 2
  Obtained from an environmental sample

SEQ ID NO: 977 - DNA, 45 bp, Artificial Sequence
  Oligonucleotide
ccatgggaggatccagatctcatcaccatcaccatcactaagctt

SEQ ID NO: 978 - DNA, 42 bp, Artificial Sequence
  Oligonucleotide
ccgccccatatgaacgcactaggatattacaacggaaaatgg

SEQ ID NO: 979 - DNA, 37 bp, Artificial Sequence
  Oligonucleotide
ggcggatccttatccaaagaattcggcacgagctgtc

SEQ ID NO: 980 - DNA, 36 bp, Artificial Sequence
  Oligonucleotide
ccgccccatatgcgcgaaattgtttttttgaatggg

SEQ ID NO: 981 - DNA, 45 bp, Artificial Sequence
  Oligonucleotide
cggatccctaaaccatctcaaaaaacttttgctgaataaaccgtg

SEQ ID NO: 982 - DNA, 39 bp, Artificial Sequence
  Oligonucleotide
ccgccccatatgttggatgaacggatggtgttcattaac

SEQ ID NO: 983 - DNA, 35 bp, Artificial Sequence
  Oligonucleotide
ggcggatccctagtccacggcatagagccactcgg

SEQ ID NO: 984 - DNA, 40 bp, Artificial Sequence
  Oligonucleotide
ggccgcatatggacgcactgggatattacaacggaaaatg

SEQ ID NO: 985 - DNA, 41 bp, Artificial Sequence
  Oligonucleotide
ggccgcggccgcctatgcctttctccactcaggcgtgtagc

SEQ ID NO: 986 - DNA, 40 bp, Artificial Sequence; identical to SEQ ID NO: 984
  Oligonucleotide

SEQ ID NO: 987 - DNA, 42 bp, Artificial Sequence
  Oligonucleotide
ggccgcggccgcctatactgtgctccactcaggcgtgtagcc

SEQ ID NO: 988 - DNA, 37 bp, Artificial Sequence
  Oligonucleotide
catatgtattcattatggaatgatcaaatagtgaagg

SEQ ID NO: 989 - DNA, 40 bp, Artificial Sequence
  Oligonucleotide
gcggccgcctatttattcgtaaaaggtgttggaattttcg

SEQ ID NO: 990 - DNA, 25 bp, Artificial Sequence
  Oligonucleotide
catatgagcaccccgccgaccaatc

SEQ ID NO: 991 - DNA, 32 bp, Artificial Sequence
  Oligonucleotide
gcggccgcctaggccgccttcacttcacgctc

SEQ ID NO: 992 - DNA, 26 bp, Artificial Sequence
  Oligonucleotide
catatgagcaccccgccaaccaattc

SEQ ID NO: 993 - DNA, 30 bp, Artificial Sequence
  Oligonucleotide
gcggccgcctacgcggccttcacttcgcgc

SEQ ID NO: 994 - DNA, 34 bp, Artificial Sequence
  Oligonucleotide
tccaggcatatgagcacagtatatttaaatggcc

SEQ ID NO: 995 - DNA, 39 bp, Artificial Sequence
  Oligonucleotide
ccagtagcggccgcctaacactcaacactatacttatgc

SEQ ID NO: 996 - DNA, 29 bp, Artificial Sequence
  Oligonucleotide
tctaggcatatggtttatctgaacgggcg

SEQ ID NO: 997 - DNA, 34 bp, Artificial Sequence
  Oligonucleotide
actgtagcggcggcctatccgagggacgcgttgg

SEQ ID NO: 998 - DNA, 36 bp, Artificial Sequence
  Oligonucleotide
catatgaaagagctgggctattacaacggaaaaatc

SEQ ID NO: 999 - DNA, 39 bp, Artificial Sequence
  Oligonucleotide
gcggccgcctatgacctccacccctgatttccaaaatac

SEQ ID NO: 1000 - DNA, 33 bp, Artificial Sequence
  Oligonucleotide
ctaggattccatatgaagaattcgccgatcatc

SEQ ID NO: 1001 - DNA, 27 bp, Artificial Sequence
  Oligonucleotide
cgaagcttcaacagcggccgcttaaag

SEQ ID NO: 1002 - DNA, 45 bp, Artificial Sequence
  Oligonucleotide
aattatttgtttcatcaacaaattctgaaattacgccggttattg

SEQ ID NO: 1003 - DNA, 32 bp, Artificial Sequence
  Oligonucleotide
cttgtgtccagcagcaacacactcggccttag

SEQ ID NO: 1004 - DNA, 31 bp, Artificial Sequence
  Oligonucleotide
gtccagcagcggcaacctcggccttagcgcc

SEQ ID NO: 1005 - DNA, 37 bp, Artificial Sequence; identical to SEQ ID NO: 988
  Oligonucleotide

SEQ ID NO: 1006 - DNA, 39 bp, Artificial Sequence
  Oligonucleotide
ctcgagtttattcgtaaaaggtgttggaattttcgtttc

SEQ ID NO: 1007 - DNA, 40 bp, Artificial Sequence
  Oligonucleotide
catatgagttatagcttatggaatgaccaaattgtgaatg

SEQ ID NO: 1008 - DNA, 36 bp, Artificial Sequence
  Oligonucleotide
ctcgagtgcgcgaataccttttgggattttcgtatc

SEQ ID NO: 1009 - DNA, 33 bp, Artificial Sequence
  Oligonucleotide
ctaggatctcatatggacgcactgggatattac

SEQ ID NO: 1010 - DNA, 26 bp, Artificial Sequence
  Oligonucleotide
gcctcgagtaccctgctccactcagg

SEQ ID NO: 1011 - DNA, 33 bp, Artificial Sequence
  Oligonucleotide
ctaggattccatatggacgcgcttggctattac

SEQ ID NO: 1012 - DNA, 25 bp, Artificial Sequence
  Oligonucleotide
gcctcgagtaccctgctccacgcag

SEQ ID NO: 1013 - DNA, 27 bp, Artificial Sequence
  Oligonucleotide
ggttcatatggagaatttaggttatta

SEQ ID NO: 1014 - DNA, 32 bp, Artificial Sequence
  Oligonucleotide
ggaagcggccgcatattctacctcctattctg

SEQ ID NO: 1015 - DNA, 40 bp, Artificial Sequence
  Oligonucleotide
ggttcatatgaaagatttaggatattacaatggagaatac

SEQ ID NO: 1016 - DNA, 42 bp, Artificial Sequence
  Oligonucleotide
ggaagcggccgcttaatttgtttcttccaaaaattcattaag

SEQ ID NO: 1017 - DNA, 40 bp, Artificial Sequence
  Oligonucleotide
atgaagcaagttggatactacaatggtactatcgctgatt

SEQ ID NO: 1018 - DNA, 39 bp, Artificial Sequence
  Oligonucleotide
taaatgaacttaaggtgcctgctactgatcgtgcacttt

SEQ ID NO: 1019 - DNA, 40 bp, Artificial Sequence
  Oligonucleotide
ttttggtgatggttgctacgatgcaactacatttaagaac

SEQ ID NO: 1020 - DNA, 40 bp, Artificial Sequence
  Oligonucleotide
aatgttgcatttgccttagaagatcatcttgatcgttttt

SEQ ID NO: 1021 - DNA, 40 bp, Artificial Sequence
  Oligonucleotide
ataatagttgtcgcctactagagatcgatttccctttaaa

SEQ ID NO: 1022 - DNA, 40 bp, Artificial Sequence
  Oligonucleotide
tcgcgatgaacttaaagaaaagctttacgctgttattgat

SEQ ID NO: 1023 - DNA, 40 bp, Artificial Sequence
  Oligonucleotide
gctaacgaagttgatactggtatcctttattggcaaactt

SEQ ID NO: 1024 - DNA, 40 bp, Artificial Sequence
  Oligonucleotide
cacgtggttctggtttacgtaaccatattttcccagaaga

SEQ ID NO: 1025 - DNA, 40 bp, Artificial Sequence
  Oligonucleotide
tagccaacctaatttattaatttttactgctccttatggt

SEQ ID NO: 1026 - DNA, 40 bp, Artificial Sequence
  Oligonucleotide
ttagttccatttgatactgaatataaacttatatctcgcg

SEQ ID NO: 1027 - DNA, 40 bp, Artificial Sequence
  Oligonucleotide
aagacactcgcttcttacattgcaatattaaaactttgaa

SEQ ID NO: 1028 - DNA, 40 bp, Artificial Sequence
  Oligonucleotide
tttacttccaaacgttattgcaagtcaaaaggctaatgaa

SEQ ID NO: 1029 - DNA, 40 bp, Artificial Sequence
  Oligonucleotide
agtcattgccaagaagtggtcttccatcgcggtgacagag

SEQ ID NO: 1030 - DNA, 40 bp, Artificial Sequence
  Oligonucleotide
ttacagaatgtgcacactctaacatcttaattctaaaaga

SEQ ID NO: 1031 - DNA, 40 bp, Artificial Sequence
  Oligonucleotide
tggcgttctttgctccccacctagagataatttaatcttg

SEQ ID NO: 1032 - DNA, 40 bp, Artificial Sequence
  Oligonucleotide
ccaggaattactttgaaacatctcttgcaattagcaaaag

SEQ ID NO: 1033 - DNA, 40 bp, Artificial Sequence
  Oligonucleotide
aaaataatattcctacttccgaagcaccattcactatgga

SEQ ID NO: 1034 - DNA, 40 bp, Artificial Sequence
  Oligonucleotide
tgatcttagaaatgctgatgaagttattgttagttcttca

SEQ ID NO: 1035 - DNA, 40 bp, Artificial Sequence
  Oligonucleotide
gcttgtctaggtattcgcgcagtcgagcttgatggtcagc

SEQ ID NO: 1036 - DNA, 40 bp, Artificial Sequence
  Oligonucleotide
ctgttggtggaaaagatggaaagactttaaagatcttgca

SEQ ID NO: 1037 - DNA, 46 bp, Artificial Sequence
  Oligonucleotide
agatgcttatgctaagaaatataatgctgaaactgtaagtcgttaa

SEQ ID NO: 1038 - DNA, 20 bp, Artificial Sequence
  Oligonucleotide
tagtatccaacttgcttcat

SEQ ID NO: 1039 - DNA, 40 bp, Artificial Sequence
  Oligonucleotide
aggcaccttaagttcatttaaatcagcgatagtaccattg

SEQ ID NO: 1040 - DNA, 40 bp, Artificial Sequence
  Oligonucleotide
cgtagcaaccatcaccaaaataaagtgcacgatcagtagc

SEQ ID NO: 1041 - DNA, 40 bp, Artificial Sequence
  Oligonucleotide
tctaaggcaaatgcaacattgttcttaaatgtagttgcat

SEQ ID NO: 1042 - DNA, 40 bp, Artificial Sequence
  Oligonucleotide
tagtaggcgacaactattataaaaacgatcaagatgatct

SEQ ID NO: 1043 - DNA, 40 bp, Artificial Sequence
  Oligonucleotide
tttctttaagttcatcgcgatttaaagggaaatcgatctc

SEQ ID NO: 1044 - DNA, 40 bp, Artificial Sequence
  Oligonucleotide
ccagtatcaacttcgttagcatcaataacagcgtaaagct

SEQ ID NO: 1045 - DNA, 40 bp, Artificial Sequence
  Oligonucleotide
acgtaaaccagaaccacgtgaagtttgccaataaaggata

SEQ ID NO: 1046 - DNA, 40 bp, Artificial Sequence
  Oligonucleotide
ttaataaattaggttggctatcttctgggaaaatatggtt

SEQ ID NO: 1047 - DNA, 40 bp, Artificial Sequence
  Oligonucleotide
tcagtatcaaatggaactaaaccataaggagcagtaaaaa

SEQ ID NO: 1048 - DNA, 40 bp, Artificial Sequence
  Oligonucleotide
atgtaagaagcgagtgtcttcgcgagatataagtttatat

SEQ ID NO: 1049 - DNA, 40 bp, Artificial Sequence
  Oligonucleotide
caataacgtttggaagtaaattcaaagttttaatattgca

SEQ ID NO: 1050 - DNA, 40 bp, Artificial Sequence
  Oligonucleotide
accacttcttggcaatgactttcattagccttttgacttg

SEQ ID NO: 1051 - DNA, 40 bp, Artificial Sequence
  Oligonucleotide
agagtgtgcacattctgtaactctgtcaccgcgatggaag

SEQ ID NO: 1052 - DNA, 40 bp, Artificial Sequence
  Oligonucleotide
gtggggagcaaagaacgccatcttttagaattaagatgtt

SEQ ID NO: 1053 - DNA, 40 bp, Artificial Sequence
  Oligonucleotide
tgtttcaaagtaattcctggcaagattaaattatctctag

SEQ ID NO: 1054 - DNA, 40 bp, Artificial Sequence
  Oligonucleotide
ggaagtaggaatattattttcttttgctaattgcaagaga

SEQ ID NO: 1055 - DNA, 40 bp, Artificial Sequence
  Oligonucleotide
catcagcatttctaagatcatccatagtgaatggtgcttc

SEQ ID NO: 1056 - DNA, 40 bp, Artificial Sequence
  Oligonucleotide
gcgcgaatacctagacaagctgaagaactaacaataactt

SEQ ID NO: 1057 - DNA, 40 bp, Artificial Sequence
  Oligonucleotide
tccatcttttccaccaacaggctgaccatcaagctcgact

SEQ ID NO: 1058 - DNA, 40 bp, Artificial Sequence
  Oligonucleotide
atttcttagcataagcatcttgcaagatctttaaagtctt

SEQ ID NO: 1059 - DNA, 26 bp, Artificial Sequence
  Oligonucleotide
ttaacgacttacagtttcagcattat

SEQ ID NO: 1060 - DNA, 33 bp, Artificial Sequence
  Oligonucleotide
ttggccaagcggccgcttaacgacttacagttt

SEQ ID NO: 1061 - DNA, 33 bp, Artificial Sequence
  Oligonucleotide
ggttccaaggcatatgaagcaagttggatacta

SEQ ID NO: 1062 - DNA, 35 bp, Artificial Sequence
  Oligonucleotide
gtgattgtttcatcaacgaattcagaagtaacgcc

SEQ ID NO: 1063 - DNA, 843 bp, Clostridium acetobutylicum
atgaaagatttaggatattacaatggagaatacgacttaattgaaaatatgaaaataccaatgaatgatcgtgtatgctattttggtgatggtgtttatgatgctacttatagtagaaaccataatatatttgcactagatgagcatattgaccgattttataatagtgccgagcttttaagaattaaaattccatatacaaagaaggaaatgaaagagcttttaaaggatatggttaaaaaggttgatagcggagaacaatttgtatattggcaggttactagaggtactggcatgcgtaatcatgcttttttgagtgaggatgttaaggctaatatttggattgttttaaagccactaaaggtaaaagatatgtcaaaaaaattaaaactaataacattagaggatactagatttttacattgtaacataaaaaccttaaatttgcttcctagtgtaattgcagcacaaaaaactgaagaagcaggctgccaggaagcagtatttcatagaggagatagagttactgaatgtgctcatagtaatgtttcaattataaaggatgagattttaaaaactgcgccaacagataatcttattttgccgggaatagcaagggcgcatcttataaaaatgtgcaaaaaatttgagatacctgtagatgaaactccatttacattaaaggagttaattaatgcggatgaagttatagttacaagttcagggcaattttgtatgactgcttgtgagatagatggaagacctgtaggcggaaaagcgccagatattattaaaaagcttcagactgccttacttaatgaatttttggaagaaacaaattaa

SEQ ID NO: 1064 - protein, 280 aa, Clostridium acetobutylicum
MKDLGYYNGEYDLIENMKIPMNDRVCYFGDGVYDATYSRNHNIFALDEHIDRFYNSAELLRIKIPYTKKEMKELLKDMVKKVDSGEQFVYWQVTRGTGMRNHAFLSEDVKANIWIVLKPLKVKDMSKKLKLITLEDTRFLHCNIKTLNLLPSVIAAQKTEEAGCQEAVFHRGDRVTECAHSNVSIIKDEILKTAPTDNLILPGIARAHLIKMCKKFEIPVDETPFTLKELINADEVIVTSSGQFCMTACEIDGRPVGGKAPDIIKKLQTALLNEFLEETN

SEQ ID NO: 1065 - DNA, 849 bp, Clostridium beijerinckii
atggagaatttaggttattataatggaaagtttggattattagaggaaatgacagtaccaatgcttgatcgtgtttgctattttggagatggagtttatgatgctacttatagcagaaatcacaagatttttgcattggaggagcatattgaaagattttacaacagcgctggtttattaggaattaaaattccttattcaaaggagcaagtaaaagaaatccttaaggagatggtattaaaggttgattcaggagaacaatttgtatattggcaaattactagaggaactggaatgagaaatcatgcttttcctggagatgaggtccctgcaaatctatggattatgttaaagcctttaaatattaaggatatgtcacaaaaattaaagttaatcactttagaagacactagatttttacactgtaatatcaaaaccttaaatttattaccaagtgtaattgcatctcaaaaaactgaagaggcaggatgtcaggaagctgtatttcatagaggggatagagtaactgaatgtgcacatagcaatgtatcaattattaaggatggtatattaaaaactgctccaacagacaatttaattttaccaggtatagcaagagctcaccttattaaaatgtgtaaatcctttaatattcctgtagatgaaacagcatttaccttgaaggaattaatggaggcagatgaagttatagttactagttcaggtcaattttgtatggcaaccagtgaaatagatggaatacctgtagggggaaaagcaccagagcttgtaaagaaattacaagatgcattgttaaatgagttcttagaagaaacaaaaacagaatag

SEQ ID NO: 1066 - protein, 282 aa, Clostridium beijerinckii
MENLGYYNGKFGLLEEMTVPMLDRVCYFGDGVYDATYSRNHKIFALEEHIERFYNSAGLLGIKIPYSKEQVKEILKEMVLKVDSGEQFVYWQITRGTGMRNHAFPGDEVPANLWIMLKPLNIKDMSQKLKLITLEDTRFLHCNIKTLNLLPSVIASQKTEEAGCQEAVFHRGDRVTECAHSNVSIIKDGILKTAPTDNLILPGIARAHLIKMCKSFNIPVDETAFTLKELMEADEVIVTSSGQFCMATSEIDGIPVGGKAPELVKKLQDALLNEFLEETKTE

SEQ ID NO: 1067 - DNA, 846 bp, Lactobacillus salivarius
atgaagcaagttggatactacaatggtactatcgctgatttaaatgaacttaaggtgcctgctactgatcgtgcactttattttggtgatggttgctacgatgcaactacatttaagaacaatgttgcatttgccttagaagatcatcttgatcgtttttataatagttgtcgcctactagagatcgatttccctttaaatcgcgatgaacttaaagaaaagctttacgctgttattgatgctaacgaagttgatactggtatcctttattggcaaacttcacgtggttctggtttacgtaaccatattttcccagaagatagccaacctaatttattaatttttactgctccttatggtttagttccatttgatactgaatataaacttatatctcgcgaagacactcgcttcttacattgcaatattaaaactttgaatttacttccaaacgttattgcaagtcaaaaggctaatgaaagtcattgccaagaagtggtcttccatcgcggtgacagagttacagaatgtgcacactctaacatcttaattctaaaagatggcgttctttgctccccacctagagataatttaatcttgccaggaattactttgaaacatctcttgcaattagcaaaagaaaataatattcctacttccgaagcaccattcactatggatgatcttagaaatgctgatgaagttattgttagttcttcagcttgtctaggtattcgcgcagtcgagcttgatggtcagcctgttggtggaaaagatggaaagactttaaagatcttgcaagatgcttatgctaagaaatataatgctgaaactgtaagtcgttaa

SEQ ID NO: 1068 - protein, 281 aa, Lactobacillus salivarius
MKQVGYYNGTIADLNELKVPATDRALYFGDGCYDATTFKNNVAFALEDHLDRFYNSCRLLEIDFPLNRDELKEKLYAVIDANEVDTGILYWQTSRGSGLRNHIFPEDSQPNLLIFTAPYGLVPFDTEYKLISREDTRFLHCNIKTLNLLPNVIASQKANESHCQEVVFHRGDRVTECAHSNILILKDGVLCSPPRDNLILPGITLKHLLQLAKENNIPTSEAPFTMDDLRNADEVIVSSSACLGIRAVELDGQPVGGKDGKTLKILQDAYAKKYNAETVSR

SEQ ID NO: 1069 - protein, 60183 aa, Artificial Sequence
  Description of Artificial Sequence: Synthetic consensus sequence
  MOD_RES (2)..(1001): This region may encompass 0-1,000 residues chosen from any of the twenty naturally occurring  amino acids; see specification for preferred embodiments
  MOD_RES (1006)..(2005): This region may encompass 0-1,000 residues chosen from any of the twenty naturally occurring amino acids; see specification for preferred embodiments
  MOD_RES (2008)..(3007): This region may encompass 0-1,000 residues chosen from any of the twenty naturally occurring amino acids; see specification for preferred embodiments
  MOD_RES (3018)..(4017): This region may encompass 0-1,000 residues chosen from any of the twenty naturally occurring amino acids; see specification for preferred embodiments
  MOD_RES (4021)..(5020): This region may encompass 0-1,000 residues chosen from any of the twenty naturally occurring amino acids; see specification for preferred embodiments
  MOD_RES (5024)..(6023): This region may encompass 0-1,000 residues chosen from any of the twenty naturally occurring amino acids; see specification for preferred embodiments
  MOD_RES (6025)..(7024): This region may encompass 0-1,000 residues chosen from any of the twenty naturally occurring amino acids; see specification for preferred embodiments
  MOD_RES (7027)..(8026): This region may encompass 0-1,000 residues chosen from any of the twenty naturally occurring amino acids; see specification for preferred embodiments
  MOD_RES (8029)..(9028): This region may encompass 0-1,000 residues chosen from any of the twenty naturally occurring amino acids; see specification for preferred embodiments
  MOD_RES (9031)..(10030): This region may encompass 0-1,000 residues chosen from any of the twenty naturally occurring amino acids; see specification for preferred embodiments
  MOD_RES (10038)..(11037): This region may encompass 0-1,000 residues chosen from any of the twenty naturally occurring amino acids; see specification for preferred embodiments
  MOD_RES (11042)..(12041): This region may encompass 0-1,000 residues chosen from any of the twenty naturally occurring amino acids; see specification for preferred embodiments
  MOD_RES (12043)..(13042): This region may encompass 0-1,000 residues chosen from any of the twenty naturally occurring amino acids; see specification for preferred embodiments
  MOD_RES (13046)..(14045): This region may encompass 0-1,000 residues chosen from any of the twenty naturally occurring amino acids; see specification for preferred embodiments
  MOD_RES (14047)..(15046): This region may encompass 0-1,000 residues chosen from any of the twenty naturally occurring amino acids; see specification for preferred embodiments
  MOD_RES (15048)..(16047): This region may encompass 0-1,000 residues chosen from any of the twenty naturally occurring amino acids; see specification for preferred embodiments
  MOD_RES (16049)..(17048): This region may encompass 0-1,000 residues chosen from any of the twenty naturally occurring amino acids; see specification for preferred embodiments
  MOD_RES (17051)..(18050): This region may encompass 0-1,000 residues chosen from any of the twenty naturally occurring amino acids; see specification for preferred embodiments
  MOD_RES (18054)..(19053): This region may encompass 0-1,000 residues chosen from any of the twenty naturally occurring amino acids; see specification for preferred embodiments
  MOD_RES (19059)..(20058): This region may encompass 0-1,000 residues chosen from any of the twenty naturally occurring amino acids; see specification for preferred embodiments
  MOD_RES (20068)..(21067): This region may encompass 0-1,000 residues chosen from any of the twenty naturally occurring amino acids; see specification for preferred embodiments
  MOD_RES (21069)..(22068): This region may encompass 0-1,000 residues chosen from any of the twenty naturally occurring amino acids; see specification for preferred embodiments
  MOD_RES (22070)..(23069): This region may encompass 0-1,000 residues chosen from any of the twenty naturally occurring amino acids; see specification for preferred embodiments
  MOD_RES (23073)..(24072): This region may encompass 0-1,000 residues chosen from any of the twenty naturally occurring amino acids; see specification for preferred embodiments
  MOD_RES (24074)..(25073): This region may encompass 0-1,000 residues chosen from any of the twenty naturally occurring amino acids; see specification for preferred embodiments
  MOD_RES (25075)..(26074): This region may encompass 0-1,000 residues chosen from any of the twenty naturally occurring amino acids; see specification for preferred embodiments
  MOD_RES (26076)..(27075): This region may encompass 0-1,000 residues chosen from any of the twenty naturally occurring amino acids; see specification for preferred embodiments
  MOD_RES (27077)..(28076): This region may encompass 0-1,000 residues chosen from any of the twenty naturally occurring amino acids; see specification for preferred embodiments
  MOD_RES (28083)..(29082): This region may encompass 0-1,000 residues chosen from any of the twenty naturally occurring amino acids; see specification for preferred embodiments
  MOD_RES (29086)..(30085): This region may encompass 0-1,000 residues chosen from any of the twenty naturally occurring amino acids; see specification for preferred embodiments
  MOD_RES (30116)..(31115): This region may encompass 0-1,000 residues chosen from any of the twenty naturally occurring amino acids; see specification for preferred embodiments
  MOD_RES (31119)..(32118): This region may encompass 0-1,000 residues chosen from any of the twenty naturally occurring amino acids; see specification for preferred embodiments
  MOD_RES (32120)..(33119): This region may encompass 0-1,000 residues chosen from any of the twenty naturally occurring amino acids; see specification for preferred embodiments
  MOD_RES (33122)..(34121): This region may encompass 0-1,000 residues chosen from any of the twenty naturally occurring amino acids; see specification for preferred embodiments
  MOD_RES (34124)..(35123): This region may encompass 0-1,000 residues chosen from any of the twenty naturally occurring amino acids; see specification for preferred embodiments
  MOD_RES (35125)..(36124): This region may encompass 0-1,000 residues chosen from any of the twenty naturally occurring amino acids; see specification for preferred embodiments
  MOD_RES (36128)..(37127): This region may encompass 0-1,000 residues chosen from any of the twenty naturally occurring amino acids; see specification for preferred embodiments
  MOD_RES (37136)..(38135): This region may encompass 0-1,000 residues chosen from any of the twenty naturally occurring amino acids; see specification for preferred embodiments
  MOD_RES (38137)..(39136): This region may encompass 0-1,000 residues chosen from any of the twenty naturally occurring amino acids; see specification for preferred embodiments
  MOD_RES (39144)..(40143): This region may encompass 0-1,000 residues chosen from any of the twenty naturally occurring amino acids; see specification for preferred embodiments
  MOD_RES (40145)..(41144): This region may encompass 0-1,000 residues chosen from any of the twenty naturally occurring amino acids; see specification for preferred embodiments
  MOD_RES (41152)..(42151): This region may encompass 0-1,000 residues chosen from any of the twenty naturally occurring amino acids; see specification for preferred embodiments
  MOD_RES (42154)..(43153): This region may encompass 0-1,000 residues chosen from any of the twenty naturally occurring amino acids; see specification for preferred embodiments
  MOD_RES (43155)..(44154): This region may encompass 0-1,000 residues chosen from any of the twenty naturally occurring amino acids; see specification for preferred embodiments
  MOD_RES (44156)..(45155): This region may encompass 0-1,000 residues chosen from any of the twenty naturally occurring amino acids; see specification for preferred embodiments
  MOD_RES (45157)..(46156): This region may encompass 0-1,000 residues chosen from any of the twenty naturally occurring amino acids; see specification for preferred embodiments
  MOD_RES (46162)..(47161): This region may encompass 0-1,000 residues chosen from any of the twenty naturally occurring amino acids; see specification for preferred embodiments
  MOD_RES (47163)..(48162): This region may encompass 0-1,000 residues chosen from any of the twenty naturally occurring amino acids; see specification for preferred embodiments
  MOD_RES (48164)..(49163): This region may encompass 0-1,000 residues chosen from any of the twenty naturally occurring amino acids; see specification for preferred embodiments
  MOD_RES (49166)..(50165): This region may encompass 0-1,000 residues chosen from any of the twenty naturally occurring amino acids; see specification for preferred embodiments
  MOD_RES (50168)..(51167): This region may encompass 0-1,000 residues chosen from any of the twenty naturally occurring amino acids; see specification for preferred embodiments
  MOD_RES (51169)..(52168): This region may encompass 0-1,000 residues chosen from any of the twenty naturally occurring amino acids; see specification for preferred embodiments
  MOD_RES (52171)..(53170): This region may encompass 0-1,000 residues chosen from any of the twenty naturally occurring amino acids; see specification for preferred embodiments
  MOD_RES (53173)..(54172): This region may encompass 0-1,000 residues chosen from any of the twenty naturally occurring amino acids; see specification for preferred embodiments
  MOD_RES (54175)..(55174): This region may encompass 0-1,000 residues chosen from any of the twenty naturally occurring amino acids; see specification for preferred embodiments
  MOD_RES (55176)..(56175): This region may encompass 0-1,000 residues chosen from any of the twenty naturally occurring amino acids; see specification for preferred embodiments
  MOD_RES (56179)..(57178): This region may encompass 0-1,000 residues chosen from any of the twenty naturally occurring amino acids; see specification for preferred embodiments
  MOD_RES (57181)..(58180): This region may encompass 0-1,000 residues chosen from any of the twenty naturally occurring amino acids; see specification for preferred embodiments
  MOD_RES (58182)..(59181): This region may encompass 0-1,000 residues chosen from any of the twenty naturally occurring amino acids; see specification for preferred embodiments
  MOD_RES (59183)..(60182): This region may encompass 0-1,000 residues chosen from any of the twenty naturally occurring amino acids; see specification for preferred embodiments
YXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLWNDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEDRGYQFGDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYEVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKVYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYECAEKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPYTKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYFQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRGVAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRVHNFPAGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKGVKATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTEDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRWLRCDIKSLNLLGAVLAKQEAIEKGCYEAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLHRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGIKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTLYTHPAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILRGITRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTCAKEIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLEMDEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXP

SEQ ID NO: 1070 - protein, 267 aa, Artificial Sequence
  Description of Artificial Sequence: Synthetic consensus sequence
  MOD_RES (2)..(2): Ser or Thr
  MOD_RES (7)..(7): Gln or Lys
  MOD_RES (10)..(10): Asp or Glu
  MOD_RES (11)..(12): Any amino acid
  MOD_RES (13)..(13): Val or Ile
  MOD_RES (14)..(14): Ile or Val
  MOD_RES (15)..(16): Any amino acid
  MOD_RES (27)..(27): Ile or Val
  MOD_RES (31)..(31): Ile or Val
  MOD_RES (35)..(35): Asn or Asp
  MOD_RES (37)..(37): Met or Leu
  MOD_RES (40)..(41): Any amino acid
  MOD_RES (44)..(44): Ile or Val
  MOD_RES (47)..(47): Any amino acid
  MOD_RES (55)..(55): Arg or Lys
  MOD_RES (56)..(56): Leu, Ile or Val
  MOD_RES (57)..(57): Ile or Val
  MOD_RES (62)..(64): Any amino acid
  MOD_RES (66)..(66): Gln or Lys
  MOD_RES (70)..(70): Any amino acid
  MOD_RES (72)..(72): Val or Ile
  MOD_RES (74)..(74): Any amino acid
  MOD_RES (76)..(76): Leu or Val
  MOD_RES (77)..(77): Any amino acid
  MOD_RES (80)..(80): His or Asn
  MOD_RES (81)..(81): Ile, Val or Leu
  MOD_RES (85)..(85): Ile or Val
  MOD_RES (91)..(91): Any amino acid
  MOD_RES (101)..(101): Val or Ile
  MOD_RES (103)..(103): Any amino acid
  MOD_RES (105)..(105): Leu or Ile
  MOD_RES (109)..(109): Any amino acid
  MOD_RES (111)..(111): Any amino acid
  MOD_RES (113)..(113): Any amino acid
  MOD_RES (115)..(117): Any amino acid
  MOD_RES (119)..(119): Glu or Gln
  MOD_RES (126)..(126): Any amino acid
  MOD_RES (130)..(130): Ile or Val
  MOD_RES (161)..(161): Ile or Val
  MOD_RES (165)..(165): Any amino acid
  MOD_RES (167)..(167): Val or Ile
  MOD_RES (170)..(170): Any amino acid
  MOD_RES (173)..(173): Any amino acid
  MOD_RES (175)..(175): Val or Ile
  MOD_RES (176)..(176): Phe or Tyr
  MOD_RES (180)..(180): Asp or Asn
  MOD_RES (189)..(189): Asn or Asp
  MOD_RES (191)..(191): Any amino acid
  MOD_RES (199)..(199): Any amino acid
  MOD_RES (201)..(201): Ile or Val
  MOD_RES (202)..(202): Leu or Ile
  MOD_RES (210)..(210): Leu, Met or Ile
  MOD_RES (213)..(213): Glu or Gln
  MOD_RES (215)..(216): Any amino acid
  MOD_RES (218)..(218): Any amino acid
  MOD_RES (220)..(221): Any amino acid
  MOD_RES (227)..(227): Leu, Ile, Val or Met
  MOD_RES (228)..(228): Any amino acid
  MOD_RES (230)..(230): Ser or Thr
  MOD_RES (232)..(232): Thr or Ser
  MOD_RES (235)..(235): Ile or Val
  MOD_RES (238)..(238): Val or Ile
  MOD_RES (240)..(240): Asp or Glu
  MOD_RES (241)..(241): Ile, Val or Leu
  MOD_RES (244)..(244): Any amino acid
  MOD_RES (247)..(247): Any amino acid
  MOD_RES (250)..(251): Any amino acid
  MOD_RES (253)..(253): Glu or Asp
  MOD_RES (257)..(257): Lys or Gln
  MOD_RES (260)..(261): Any amino acid
  MOD_RES (263)..(264): Any amino acid
  MOD_RES (266)..(266): Ile or Leu
YXLWNDXIVXXXXXXXEDRGYQFGDGXYEVXKVYXGXFTXXEHXDRXYECAEKIXXXPYTKXXXHXLLHXLXEXNXXTGXXYFQXTRGVAXRVHNFPAGNXQXVXSGTXKXFXRXXXNXKGVKATXTEDXRWLRCDIKSLNLLGAVLAKQEAIEKGCYEAXLHRXGXTEXSSXNXXGIKXGTLYTHPAXNXILRGITRXVXXTCAKEIEXPVXQXXTXKXXLEMDEXXVXSXSEXTPXIXXDGXKIXNGXXGXWTRXLQXXFXXKXP

SEQ ID NO: 1071 - protein, 49105 aa, Artificial Sequence
  Description of Artificial Sequence: Synthetic consensus sequence
  MOD_RES (2)..(1001): This region may encompass 0-1,000 residues chosen from any of the twenty naturally occurring  amino acids; see specification for preferred embodiments
  MOD_RES (1007)..(2006): This region may encompass 0-1,000 residues chosen from any of the twenty naturally occurring  amino acids; see specification for preferred embodiments
  MOD_RES (2008)..(3007): This region may encompass 0-1,000 residues chosen from any of the twenty naturally occurring  amino acids; see specification for preferred embodiments
  MOD_RES (3010)..(4009): This region may encompass 0-1,000 residues chosen from any of the twenty naturally occurring  amino acids; see specification for preferred embodiments
  MOD_RES (4014)..(5013): This region may encompass 0-1,000 residues chosen from any of the twenty naturally occurring  amino acids; see specification for preferred embodiments
  MOD_RES (5018)..(6017): This region may encompass 0-1,000 residues chosen from any of the twenty naturally occurring  amino acids; see specification for preferred embodiments
  MOD_RES (6019)..(7018): This region may encompass 0-1,000 residues chosen from any of the twenty naturally occurring  amino acids; see specification for preferred embodiments
  MOD_RES (7022)..(8021): This region may encompass 0-1,000 residues chosen from any of the twenty naturally occurring  amino acids; see specification for preferred embodiments
  MOD_RES (8023)..(9022): This region may encompass 0-1,000 residues chosen from any of the twenty naturally occurring  amino acids; see specification for preferred embodiments
  MOD_RES (9025)..(10024): This region may encompass 0-1,000 residues chosen from any of the twenty naturally occurring  amino acids; see specification for preferred embodiments
  MOD_RES (10027)..(11026): This region may encompass 0-1,000 residues chosen from any of the twenty naturally occurring  amino acids; see specification for preferred embodiments
  MOD_RES (11029)..(12028): This region may encompass 0-1,000 residues chosen from any of the twenty naturally occurring  amino acids; see specification for preferred embodiments
  MOD_RES (12030)..(13029): This region may encompass 0-1,000 residues chosen from any of the twenty naturally occurring  amino acids; see specification for preferred embodiments
  MOD_RES (13031)..(14030): This region may encompass 0-1,000 residues chosen from any of the twenty naturally occurring  amino acids; see specification for preferred embodiments
  MOD_RES (14034)..(15033): This region may encompass 0-1,000 residues chosen from any of the twenty naturally occurring  amino acids; see specification for preferred embodiments
  MOD_RES (15036)..(16035): This region may encompass 0-1,000 residues chosen from any of the twenty naturally occurring  amino acids; see specification for preferred embodiments
  MOD_RES (16037)..(17036): This region may encompass 0-1,000 residues chosen from any of the twenty naturally occurring  amino acids; see specification for preferred embodiments
  MOD_RES (17038)..(18037): This region may encompass 0-1,000 residues chosen from any of the twenty naturally occurring  amino acids; see specification for preferred embodiments
  MOD_RES (18039)..(19038): This region may encompass 0-1,000 residues chosen from any of the twenty naturally occurring  amino acids; see specification for preferred embodiments
  MOD_RES (19040)..(20039): This region may encompass 0-1,000 residues chosen from any of the twenty naturally occurring  amino acids; see specification for preferred embodiments
  MOD_RES (20041)..(21040): This region may encompass 0-1,000 residues chosen from any of the twenty naturally occurring  amino acids; see specification for preferred embodiments
  MOD_RES (21042)..(22041): This region may encompass 0-1,000 residues chosen from any of the twenty naturally occurring  amino acids; see specification for preferred embodiments
  MOD_RES (22043)..(23042): This region may encompass 0-1,000 residues chosen from any of the twenty naturally occurring  amino acids; see specification for preferred embodiments
  MOD_RES (23046)..(24045): This region may encompass 0-1,000 residues chosen from any of the twenty naturally occurring  amino acids; see specification for preferred embodiments
  MOD_RES (24050)..(25049): This region may encompass 0-1,000 residues chosen from any of the twenty naturally occurring  amino acids; see specification for preferred embodiments
  MOD_RES (25059)..(26058): This region may encompass 0-1,000 residues chosen from any of the twenty naturally occurring  amino acids; see specification for preferred embodiments
  MOD_RES (26060)..(27059): This region may encompass 0-1,000 residues chosen from any of the twenty naturally occurring  amino acids; see specification for preferred embodiments
  MOD_RES (27063)..(28062): This region may encompass 0-1,000 residues chosen from any of the twenty naturally occurring  amino acids; see specification for preferred embodiments
  MOD_RES (28064)..(29063): This region may encompass 0-1,000 residues chosen from any of the twenty naturally occurring  amino acids; see specification for preferred embodiments
  MOD_RES (29065)..(30064): This region may encompass 0-1,000 residues chosen from any of the twenty naturally occurring  amino acids; see specification for preferred embodiments
  MOD_RES (30066)..(31065): This region may encompass 0-1,000 residues chosen from any of the twenty naturally occurring  amino acids; see specification for preferred embodiments
  MOD_RES (31067)..(32066): This region may encompass 0-1,000 residues chosen from any of the twenty naturally occurring  amino acids; see specification for preferred embodiments
  MOD_RES (32072)..(33071): This region may encompass 0-1,000 residues chosen from any of the twenty naturally occurring  amino acids; see specification for preferred embodiments
  MOD_RES (33080)..(34079): This region may encompass 0-1,000 residues chosen from any of the twenty naturally occurring  amino acids; see specification for preferred embodiments
  MOD_RES (34081)..(35080): This region may encompass 0-1,000 residues chosen from any of the twenty naturally occurring  amino acids; see specification for preferred embodiments
  MOD_RES (35085)..(36084): This region may encompass 0-1,000 residues chosen from any of the twenty naturally occurring  amino acids; see specification for preferred embodiments
  MOD_RES (36086)..(37085): This region may encompass 0-1,000 residues chosen from any of the twenty naturally occurring  amino acids; see specification for preferred embodiments
  MOD_RES (37088)..(38087): This region may encompass 0-1,000 residues chosen from any of the twenty naturally occurring  amino acids; see specification for preferred embodiments
  MOD_RES (38089)..(39088): This region may encompass 0-1,000 residues chosen from any of the twenty naturally occurring  amino acids; see specification for preferred embodiments
  MOD_RES (39090)..(40089): This region may encompass 0-1,000 residues chosen from any of the twenty naturally occurring  amino acids; see specification for preferred embodiments
  MOD_RES (40091)..(41090): This region may encompass 0-1,000 residues chosen from any of the twenty naturally occurring  amino acids; see specification for preferred embodiments
  MOD_RES (41092)..(42091): This region may encompass 0-1,000 residues chosen from any of the twenty naturally occurring  amino acids; see specification for preferred embodiments
  MOD_RES (42095)..(43094): This region may encompass 0-1,000 residues chosen from any of the twenty naturally occurring  amino acids; see specification for preferred embodiments
  MOD_RES (43096)..(44095): This region may encompass 0-1,000 residues chosen from any of the twenty naturally occurring  amino acids; see specification for preferred embodiments
  MOD_RES (44098)..(45097): This region may encompass 0-1,000 residues chosen from any of the twenty naturally occurring  amino acids; see specification for preferred embodiments
  MOD_RES (45100)..(46099): This region may encompass 0-1,000 residues chosen from any of the twenty naturally occurring  amino acids; see specification for preferred embodiments
  MOD_RES (46103)..(47102): This region may encompass 0-1,000 residues chosen from any of the twenty naturally occurring  amino acids; see specification for preferred embodiments
  MOD_RES (47104)..(48103): This region may encompass 0-1,000 residues chosen from any of the twenty naturally occurring  amino acids; see specification for preferred embodiments
  MOD_RES (48105)..(49104): This region may encompass 0-1,000 residues chosen from any of the twenty naturally occurring  amino acids; see specification for preferred embodiments
MXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYYNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFGDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYDATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYWQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTRFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHCNIKTLNLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFHRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTECAHSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXADEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXT

SEQ ID NO: 1072 - protein, 279 aa, Artificial Sequence
  Description of Artificial Sequence: Synthetic consensus sequence
  MOD_RES (2)..(4): Any amino acid
  MOD_RES (10)..(19): Any amino acid
  MOD_RES (21)..(22): Any amino acid
  MOD_RES (25)..(27): Any amino acid
  MOD_RES (32)..(32): Any amino acid
  MOD_RES (37)..(39): Any amino acid
  MOD_RES (41)..(43): Any amino acid
  MOD_RES (47)..(48): Any amino acid
  MOD_RES (50)..(51): Any amino acid
  MOD_RES (54)..(54): Any amino acid
  MOD_RES (57)..(58): Any amino acid
  MOD_RES (61)..(61): Any amino acid
  MOD_RES (63)..(71): Any amino acid
  MOD_RES (73)..(89): Any amino acid
  MOD_RES (93)..(94): Any amino acid
  MOD_RES (97)..(97): Any amino acid
  MOD_RES (99)..(99): Any amino acid
  MOD_RES (101)..(101): Any amino acid
  MOD_RES (103)..(103): Any amino acid
  MOD_RES (105)..(111): This region may encompass 5 or 7 residues chosen from any of the twenty naturally occurring  amino acids
  MOD_RES (113)..(114): Any amino acid
  MOD_RES (116)..(118): Any amino acid
  MOD_RES (120)..(129): Any amino acid
  MOD_RES (133)..(135): Any amino acid
  MOD_RES (140)..(140): Any amino acid
  MOD_RES (150)..(150): Any amino acid
  MOD_RES (152)..(152): Any amino acid
  MOD_RES (156)..(156): Any amino acid
  MOD_RES (158)..(160): Any amino acid
  MOD_RES (162)..(163): Any amino acid
  MOD_RES (165)..(165): Any amino acid
  MOD_RES (167)..(167): Any amino acid
  MOD_RES (173)..(174): Any amino acid
  MOD_RES (183)..(184): Any amino acid
  MOD_RES (186)..(196): Any amino acid
  MOD_RES (202)..(202): Any amino acid
  MOD_RES (204)..(207): Any amino acid
  MOD_RES (210)..(218): Any amino acid
  MOD_RES (220)..(221): Any amino acid
  MOD_RES (223)..(224): Any amino acid
  MOD_RES (226)..(229): Any amino acid
  MOD_RES (231)..(232): Any amino acid
  MOD_RES (236)..(237): Any amino acid
  MOD_RES (239)..(239): Any amino acid
  MOD_RES (242)..(251): Any amino acid
  MOD_RES (254)..(256): Any amino acid
  MOD_RES (260)..(264): Any amino acid
  MOD_RES (266)..(267): Any amino acid
  MOD_RES (269)..(278): Any amino acid
MXXXGYYNGXXXXXXXXXXPXXDRXXXFGDGXYDATXXXNXXXFALXXHXXRFXNSXXLLXIXXXXXXXXXKXXXXXXXXXXXXXXXXXYWQXXRGXGXRXHXFXXXXXXXNXXIXXXPXXXXXXXXXXKLIXXXDTRFXHCNIKTLNLXPXVIAXQXXXEXXCXEXVFHRGXXVTECAHSNXXIXXXXXXXXXXXDNLILXGXXXXHLXXXXXXXXXPXXEXXFXXXXLXXADEXXVXSSXXXXXXXXXXDGXXXGGKXXXXXKXXQXXXXXXXXXXT

SEQ ID NO: 1073 - protein, 1155 aa, Artificial Sequence
  Description of Artificial Sequence: Synthetic consensus sequence
  MOD_RES (2)..(21): This region may encompass 0-20 residues chosen from any of the twenty naturally occurring  amino acids; see specification for preferred embodiments
  MOD_RES (22)..(22): Leu or Val
  MOD_RES (28)..(47): This region may encompass 0-20 residues chosen from any of the twenty naturally occurring  amino acids; see specification for preferred embodiments
  MOD_RES (48)..(48): Leu or Ile
  MOD_RES (49)..(68): This region may encompass 0-20 residues chosen from any of the twenty naturally occurring  amino acids; see specification for preferred embodiments
  MOD_RES (69)..(69): Met or Leu
  MOD_RES (70)..(89): This region may encompass 0-20 residues chosen from any of the twenty naturally occurring  amino acids; see specification for preferred embodiments
  MOD_RES (90)..(90): Val or Ile
  MOD_RES (92)..(111): This region may encompass 0-20 residues chosen from any of the twenty naturally occurring  amino acids; see specification for preferred embodiments
  MOD_RES (114)..(133): This region may encompass 0-20 residues chosen from any of the twenty naturally occurring  amino acids; see specification for preferred embodiments
  MOD_RES (134)..(134): Tyr or Phe
  MOD_RES (139)..(158): This region may encompass 0-20 residues chosen from any of the twenty naturally occurring  amino acids; see specification for preferred embodiments
  MOD_RES (163)..(182): This region may encompass 0-20 residues chosen from any of the twenty naturally occurring  amino acids; see specification for preferred embodiments
  MOD_RES (184)..(203): This region may encompass 0-20 residues chosen from any of the twenty naturally occurring  amino acids; see specification for preferred embodiments
  MOD_RES (207)..(207): Asp or Glu
  MOD_RES (208)..(208): Glu or Asp
  MOD_RES (210)..(210): Ile or Leu
  MOD_RES (211)..(211): Asp or Glu
  MOD_RES (214)..(233): This region may encompass 0-20 residues chosen from any of the twenty naturally occurring  amino acids; see specification for preferred embodiments
  MOD_RES (236)..(255): This region may encompass 0-20 residues chosen from any of the twenty naturally occurring  amino acids; see specification for preferred embodiments
  MOD_RES (258)..(277): This region may encompass 0-20 residues chosen from any of the twenty naturally occurring  amino acids; see specification for preferred embodiments
  MOD_RES (279)..(298): This region may encompass 0-20 residues chosen from any of the twenty naturally occurring  amino acids; see specification for preferred embodiments
  MOD_RES (299)..(299): Lys or Arg
  MOD_RES (300)..(319): This region may encompass 0-20 residues chosen from any of the twenty naturally occurring  amino acids; see specification for preferred embodiments
  MOD_RES (320)..(320): Glu or Gln
  MOD_RES (321)..(321): Leu, Met or Val
  MOD_RES (323)..(323): Lys or Glu
  MOD_RES (324)..(343): This region may encompass 0-20 residues chosen from any of the twenty naturally occurring  amino acids; see specification for preferred embodiments
  MOD_RES (344)..(344): Met or Val
  MOD_RES (345)..(364): This region may encompass 0-20 residues chosen from any of the twenty naturally occurring  amino acids; see specification for preferred embodiments
  MOD_RES (365)..(365): Asp or Glu
  MOD_RES (366)..(385): This region may encompass 0-20 residues chosen from any of the twenty naturally occurring  amino acids; see specification for preferred embodiments
  MOD_RES (386)..(386): Val or Leu
  MOD_RES (390)..(409): This region may encompass 0-20 residues chosen from any of the twenty naturally occurring  amino acids; see specification for preferred embodiments
  MOD_RES (410)..(410): Thr or Ser
  MOD_RES (413)..(413): Thr or Ser
  MOD_RES (415)..(434): This region may encompass 0-20 residues chosen from any of the twenty naturally occurring  amino acids; see specification for preferred embodiments
  MOD_RES (436)..(436): Asn or Ser
  MOD_RES (438)..(457): This region may encompass 0-20 residues chosen from any of the twenty naturally occurring  amino acids; see specification for preferred embodiments
  MOD_RES (459)..(478): This region may encompass 0-20 residues chosen from any of the twenty naturally occurring  amino acids; see specification for preferred embodiments
  MOD_RES (480)..(480): Leu or Ile
  MOD_RES (481)..(500): This region may encompass 0-20 residues chosen from any of the twenty naturally occurring  amino acids; see specification for preferred embodiments
  MOD_RES (502)..(521): This region may encompass 0-20 residues chosen from any of the twenty naturally occurring  amino acids; see specification for preferred embodiments
  MOD_RES (523)..(542): This region may encompass 0-20 residues chosen from any of the twenty naturally occurring  amino acids; see specification for preferred embodiments
  MOD_RES (543)..(543): Ile, Val or Leu
  MOD_RES (544)..(563): This region may encompass 0-20 residues chosen from any of the twenty naturally occurring  amino acids; see specification for preferred embodiments
  MOD_RES (564)..(564): Lys or Glu
  MOD_RES (565)..(584): This region may encompass 0-20 residues chosen from any of the twenty naturally occurring  amino acids; see specification for preferred embodiments
  MOD_RES (588)..(588): Thr or Ser
  MOD_RES (589)..(608): This region may encompass 0-20 residues chosen from any of the twenty naturally occurring  amino acids; see specification for preferred embodiments
  MOD_RES (609)..(609): Glu or Asp
  MOD_RES (614)..(633): This region may encompass 0-20 residues chosen from any of the twenty naturally occurring  amino acids; see specification for preferred embodiments
  MOD_RES (643)..(643): Ile or Leu
  MOD_RES (645)..(645): Asn or Ser
  MOD_RES (649)..(649): Ser or Ala
  MOD_RES (651)..(651): Arg or Lys
  MOD_RES (652)..(671): This region may encompass 0-20 residues chosen from any of the twenty naturally occurring  amino acids; see specification for preferred embodiments
  MOD_RES (673)..(692): This region may encompass 0-20 residues chosen from any of the twenty naturally occurring  amino acids; see specification for preferred embodiments
  MOD_RES (694)..(713): This region may encompass 0-20 residues chosen from any of the twenty naturally occurring  amino acids; see specification for preferred embodiments
  MOD_RES (715)..(734): This region may encompass 0-20 residues chosen from any of the twenty naturally occurring  amino acids; see specification for preferred embodiments
  MOD_RES (740)..(740): Glu or Asp
  MOD_RES (741)..(760): This region may encompass 0-20 residues chosen from any of the twenty naturally occurring  amino acids; see specification for preferred embodiments
  MOD_RES (769)..(769): Val or Ile
  MOD_RES (770)..(789): This region may encompass 0-20 residues chosen from any of the twenty naturally occurring  amino acids; see specification for preferred embodiments
  MOD_RES (791)..(791): Ile or Leu
  MOD_RES (792)..(792): Lys or Arg
  MOD_RES (793)..(793): Asn or Asp
  MOD_RES (794)..(813): This region may encompass 0-20 residues chosen from any of the twenty naturally occurring  amino acids; see specification for preferred embodiments
  MOD_RES (814)..(814): Thr or Ser
  MOD_RES (815)..(834): This region may encompass 0-20 residues chosen from any of the twenty naturally occurring  amino acids; see specification for preferred embodiments
  MOD_RES (840)..(859): This region may encompass 0-20 residues chosen from any of the twenty naturally occurring  amino acids; see specification for preferred embodiments
  MOD_RES (861)..(880): This region may encompass 0-20 residues chosen from any of the twenty naturally occurring  amino acids; see specification for preferred embodiments
  MOD_RES (883)..(883): Leu or Ile
  MOD_RES (884)..(884): Gln or Lys
  MOD_RES (885)..(904): This region may encompass 0-20 residues chosen from any of the twenty naturally occurring  amino acids; see specification for preferred embodiments
  MOD_RES (905)..(905): Ile or Val
  MOD_RES (907)..(926): This region may encompass 0-20 residues chosen from any of the twenty naturally occurring  amino acids; see specification for preferred embodiments
  MOD_RES (928)..(947): This region may encompass 0-20 residues chosen from any of the twenty naturally occurring  amino acids; see specification for preferred embodiments
  MOD_RES (949)..(949): Thr or Ser
  MOD_RES (950)..(950): Leu or Met
  MOD_RES (951)..(970): This region may encompass 0-20 residues chosen from any of the twenty naturally occurring  amino acids; see specification for preferred embodiments
  MOD_RES (971)..(971): Glu or Asp
  MOD_RES (973)..(992): This region may encompass 0-20 residues chosen from any of the twenty naturally occurring  amino acids; see specification for preferred embodiments
  MOD_RES (996)..(996): Val or Ile
  MOD_RES (997)..(997): Leu or Ile
  MOD_RES (999)..(999): Ser or Thr
  MOD_RES (1002)..(1021): This region may encompass 0-20 residues chosen from any of the twenty naturally occurring  amino acids; see specification for preferred embodiments
  MOD_RES (1022)..(1022): Leu, Met or Ile
  MOD_RES (1023)..(1042): This region may encompass 0-20 residues chosen from any of the twenty naturally occurring  amino acids; see specification for preferred embodiments
  MOD_RES (1043)..(1043): Ile or Leu
  MOD_RES (1046)..(1065): This region may encompass 0-20 residues chosen from any of the twenty naturally occurring  amino acids; see specification for preferred embodiments
  MOD_RES (1069)..(1088): This region may encompass 0-20 residues chosen from any of the twenty naturally occurring  amino acids; see specification for preferred embodiments
  MOD_RES (1089)..(1089): Leu, Val or Ile
  MOD_RES (1091)..(1110): This region may encompass 0-20 residues chosen from any of the twenty naturally occurring  amino acids; see specification for preferred embodiments
  MOD_RES (1111)..(1111): Ile or Leu
  MOD_RES (1113)..(1132): This region may encompass 0-20 residues chosen from any of the twenty naturally occurring  amino acids; see specification for preferred embodiments
  MOD_RES (1133)..(1133): Glu or Lys
  MOD_RES (1134)..(1134): Phe or Tyr
  MOD_RES (1135)..(1154): This region may encompass 0-20 residues chosen from any of the twenty naturally occurring  amino acids; see specification for preferred embodiments
MXXXXXXXXXXXXXXXXXXXXXGYYNGXXXXXXXXXXXXXXXXXXXXXXXXXXXXXXXXXXXXXXXXXXXXXXXXXXXXXXXXXXXXXXXPXXXXXXXXXXXXXXXXXXXXDRXXXXXXXXXXXXXXXXXXXXXFGDGXXXXXXXXXXXXXXXXXXXXYDATXXXXXXXXXXXXXXXXXXXXNXXXXXXXXXXXXXXXXXXXXFALXXHXXRFXXXXXXXXXXXXXXXXXXXXNSXXXXXXXXXXXXXXXXXXXXLLXXXXXXXXXXXXXXXXXXXXIXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXYWQXXXXXXXXXXXXXXXXXXXXXRGXGXXXXXXXXXXXXXXXXXXXXRXHXXXXXXXXXXXXXXXXXXXXFXXXXXXXXXXXXXXXXXXXXNXXXXXXXXXXXXXXXXXXXXXIXXXXXXXXXXXXXXXXXXXXPXXXXXXXXXXXXXXXXXXXXXXXXXXXXXXXXXXXXXXXXXXXXXXXXXXXXXXXXXXXXXXKLIXXXXXXXXXXXXXXXXXXXXXXDTRFXXXXXXXXXXXXXXXXXXXXHCNIKTLNLXPXVIAXQXXXXXXXXXXXXXXXXXXXXXEXXXXXXXXXXXXXXXXXXXXCXXXXXXXXXXXXXXXXXXXXEXXXXXXXXXXXXXXXXXXXXVFHRGXXXXXXXXXXXXXXXXXXXXXVTECAHSNXXXXXXXXXXXXXXXXXXXXXIXXXXXXXXXXXXXXXXXXXXXXXXXXXXXXXXXXXXXXXXXXXXDNLILXXXXXXXXXXXXXXXXXXXXGXXXXXXXXXXXXXXXXXXXXHLXXXXXXXXXXXXXXXXXXXXXXXPXXXXXXXXXXXXXXXXXXXXEXXXXXXXXXXXXXXXXXXXXFXXXXXXXXXXXXXXXXXXXXXXXLXXXXXXXXXXXXXXXXXXXXADEXXVXSSXXXXXXXXXXXXXXXXXXXXXXXXXXXXXXXXXXXXXXXXXXDGXXXXXXXXXXXXXXXXXXXXGGKXXXXXXXXXXXXXXXXXXXXXKXXXXXXXXXXXXXXXXXXXXXQXXXXXXXXXXXXXXXXXXXXXXXXXXXXXXXXXXXXXXXXXXT

SEQ ID NO: 1074 - DNA, 38 bp, Artificial Sequence
  Oligonucleotide
ctaacggagtgatctttgctctagacgagcacattgac

SEQ ID NO: 1075 - DNA, 38 bp, Artificial Sequence
  Oligonucleotide
gtcaatgtgctcgtctagagcaaagatcactccgttag

SEQ ID NO: 1076 - DNA, 39 bp, Artificial Sequence
  Oligonucleotide
catggaagatacacgattcctccactgcaacatcaagac

SEQ ID NO: 1077 - DNA, 39 bp, Artificial Sequence
  Oligonucleotide
gtcttgatgttgcagtggaggaatcgtgtatcttccatg

SEQ ID NO: 1078 - DNA, 37 bp, Artificial Sequence
  Oligonucleotide
attgcctcccagcgggctctagaagcgggctgccacg

SEQ ID NO: 1079 - DNA, 37 bp, Artificial Sequence
  Oligonucleotide
cgtggcagcccgcttctagagcccgctgggaggcaat

SEQ ID NO: 1080 - DNA, 38 bp, Artificial Sequence
  Oligonucleotide
ggggggaaaagctcccgaactgctaaaaaaaattcagg

SEQ ID NO: 1081 - DNA, 38 bp, Artificial Sequence
  Oligonucleotide
cctgaattttttttagcaggtcgggagcttttcccccc

SEQ ID NO: 1082 - DNA, 32 bp, Artificial Sequence
  Oligonucleotide
cgcagaattcggacgcactgggatattacaac

SEQ ID NO: 1083 - DNA, 32 bp, Artificial Sequence
  Oligonucleotide
gttagcggccgcctatactgtgctccactcag

SEQ ID NO: 1084 - DNA, 33 bp, Artificial Sequence
  Oligonucleotide
atggacgcactgggatgttacaacggaaattgg

SEQ ID NO: 1085 - DNA, 33 bp, Artificial Sequence
  Oligonucleotide
ccaatttccgttgtaacatcccagtgcgtccat

SEQ ID NO: 1086 - DNA, 36 bp, Artificial Sequence
  Oligonucleotide
atggacgcactgggactttacaacggaaattggggg

SEQ ID NO: 1087 - DNA, 36 bp, Artificial Sequence
  Oligonucleotide
cccccaatttccgttgtaaagtcccagtgcgtccat

SEQ ID NO: 1088 - DNA, 39 bp, Artificial Sequence
  Oligonucleotide
tacctggtttattggcagggtactcgcggaacaggccgg

SEQ ID NO: 1089 - DNA, 39 bp, Artificial Sequence
  Oligonucleotide
ccggcctgttccgcgagtaccctgccaataaaccaggta

SEQ ID NO: 1090 - DNA, 44 bp, Artificial Sequence
  Oligonucleotide
ctctggattataattaagcccggccacatcgacaatctttatag

SEQ ID NO: 1091 - DNA, 44 bp, Artificial Sequence
  Oligonucleotide
ctataaagattgtcgatgtggccgggcttaattataatccagag

SEQ ID NO: 1092 - DNA, 44 bp, Artificial Sequence
  Oligonucleotide
ctctggattataattaagcccaggcacatcgacaatctttatag

SEQ ID NO: 1093 - DNA, 44 bp, Artificial Sequence
  Oligonucleotide
ctataaagattgtcgatgtgcctgggcttaattataatccagag

SEQ ID NO: 1094 - DNA, 44 bp, Artificial Sequence
  Oligonucleotide
gtatttccggcaggcccttcagcgctctggattataattaagcc

SEQ ID NO: 1095 - DNA, 44 bp, Artificial Sequence
  Oligonucleotide
ggcttaattataatccagagcgctgaagggcctgccggaaatac

SEQ ID NO: 1096 - DNA, 46 bp, Artificial Sequence
  Oligonucleotide
caatctttatagaaaaatcaaggttattaccatggatgatacccgc

SEQ ID NO: 1097 - DNA, 45 bp, Artificial Sequence
  Oligonucleotide
gcgggtatgatccatggtaataaccttgatttttctataaagatt

SEQ ID NO: 1098 - DNA, 46 bp, Artificial Sequence
  Oligonucleotide
cttaacaaaagaggaattgaaactgactttaaatgaaatgtactcc

SEQ ID NO: 1099 - DNA, 46 bp, Artificial Sequence
  Oligonucleotide
ggagtacatttcatttaaagtcagtttcaattcctcttttgttaag

SEQ ID NO: 1100 - DNA, 43 bp, Artificial Sequence
  Oligonucleotide
ttcgacgcggacgaggtgcttacttccagcagcggcacactcg

SEQ ID NO: 1101 - DNA, 43 bp, Artificial Sequence
  Oligonucleotide
cgagtgtgccgctgctggaagtaagcacctcgtccgcgtcgaa

SEQ ID NO: 1102 - DNA, 39 bp, Artificial Sequence
  Oligonucleotide
tgcttgtgtccagcagcggccggctcggccttagcgccg

SEQ ID NO: 1103 - DNA, 39 bp, Artificial Sequence
  Oligonucleotide
cggcgctaaggccgagccggccgctgctggacacaagca

SEQ ID NO: 1104 - DNA, 42 bp, Artificial Sequence
  Oligonucleotide
ctggacgagatgactgtgagtatgaacgacaggggctgctac

SEQ ID NO: 1105 - DNA, 39 bp, Artificial Sequence; identical to SEQ ID NO: 1102
  Oligonucleotide

SEQ ID NO: 1106 - DNA, 50 bp, Artificial Sequence
  Oligonucleotide
ctaaaaaaaatccaggatgaagtgtggagggaatttatcgaagcgacagg

SEQ ID NO: 1107 - DNA, 41 bp, Artificial Sequence
  Oligonucleotide
caaaagaggaattgaaaaaagtgttaaatgaaatgtactcc

SEQ ID NO: 1108 - DNA, 41 bp, Artificial Sequence
  Oligonucleotide
ggagtacatttcatttaacacttttttcaattcctcttttg

SEQ ID NO: 1109 - DNA, 46 bp, Artificial Sequence; identical to SEQ ID NO: 1098
  Oligonucleotide

SEQ ID NO: 1110 - DNA, 46 bp, Artificial Sequence; identical to SEQ ID NO: 1099
  Oligonucleotide

SEQ ID NO: 1111 - DNA, 42 bp, Artificial Sequence; identical to SEQ ID NO: 1104
  Oligonucleotide

SEQ ID NO: 1112 - DNA, 42 bp, Artificial Sequence
  Oligonucleotide
gtagcagcccctgtcgttcatactcacagtcatctcgtccag

SEQ ID NO: 1113 - DNA, 42 bp, Artificial Sequence; identical to SEQ ID NO: 1104
  Oligonucleotide

SEQ ID NO: 1114 - DNA, 42 bp, Artificial Sequence; identical to SEQ ID NO: 1112
  Oligonucleotide

SEQ ID NO: 1115 - DNA, 41 bp, Artificial Sequence; identical to SEQ ID NO: 1107
  Oligonucleotide

SEQ ID NO: 1116 - DNA, 43 bp, Artificial Sequence; identical to SEQ ID NO: 1100
  Oligonucleotide

SEQ ID NO: 1117 - DNA, 39 bp, Artificial Sequence; identical to SEQ ID NO: 1102
  Oligonucleotide

SEQ ID NO: 1118 - DNA, 39 bp, Artificial Sequence; identical to SEQ ID NO: 1088
  Oligonucleotide

SEQ ID NO: 1119 - DNA, 39 bp, Artificial Sequence; identical to SEQ ID NO: 1089
  Oligonucleotide

SEQ ID NO: 1120 - DNA, 39 bp, Artificial Sequence; identical to SEQ ID NO: 1088
  Oligonucleotide

SEQ ID NO: 1121 - DNA, 39 bp, Artificial Sequence; identical to SEQ ID NO: 1102
  Oligonucleotide

SEQ ID NO: 1122 - DNA, 41 bp, Artificial Sequence; identical to SEQ ID NO: 1107
  Oligonucleotide

SEQ ID NO: 1123 - DNA, 41 bp, Artificial Sequence; identical to SEQ ID NO: 1108
  Oligonucleotide

SEQ ID NO: 1124 - DNA, 42 bp, Artificial Sequence; identical to SEQ ID NO: 1104
  Oligonucleotide

SEQ ID NO: 1125 - DNA, 39 bp, Artificial Sequence; identical to SEQ ID NO: 1102
  Oligonucleotide

What is claimed is:

1. A method of converting tryptophan to indole-3-pyruvate or indole-3-pyruvate to tryptophan, comprising combining tryptophan or indole-3-pyruvate, respectively, with
    a) a nucleic acid molecule comprising the nucleotide sequence of SEQ ID NO:219, wherein said nucleic acid molecule encodes the polypeptide comprising SEQ ID NO:220; or
    b) a variant of a), wherein said variant comprises a variant nucleic acid molecule that encodes a variant polypeptide, wherein said variant polypeptide has at least 95% sequence identity to SEQ ID NO:220 and has aminotransferase activity.

2. The method of claim 1, wherein said variant encodes a variant polypeptide that has at least 99% sequence identity to SEQ ID NO:220 and has aminotransferase activity.

3. The method of claim 1, wherein said variant polypeptide is a mutant and the mutant is selected from one or more of the mutations shown in Table 43 or Table 52.

4. The method of claim 1, wherein the variant nucleic acid molecule has been codon optimized.

5. The method of claim 1, wherein the nucleic acid molecule or variant nucleic acid molecule is contained within an expression vector.

6. The method of claim 5, wherein the nucleic acid molecule or variant nucleic acid molecule is overexpressed in an isolated transformed host cell.

7. The method of claim 1, wherein the polypeptide or variant polypeptide is immobilized on a solid support.

8. The method of claim 1, wherein the variant polypeptide is a chimeric polypeptide.

9. A method of converting tryptophan to indole-3-pyruvate or indole-3-pyruvate to tryptophan, comprising combining tryptophan or indole-3-pyruvate, respectively, with a polypeptide comprising the amino acid sequence of SEQ ID NO:220.

10. The method of claim 9, wherein the polypeptide is immobilized on a solid support.

11. A method of converting tryptophan to indole-3-pyruvate or indole-3-pyruvate to tryptophan, comprising combining tryptophan or indole-3-pyruvate, respectively, with a variant polypeptide that has mat least 95% sequence identity to SEQ ID NO:220 and (ii) aminotransferase activity.

12. The method of claim 11, wherein the variant polypeptide is a mutant selected from one or more mutations shown in Table 52.

13. The method of claim 11, wherein said variant polypeptide has (i) at least 99% sequence identity to SEQ ID NO:220 and (ii) aminotransferase activity.

14. The method of claim 13, wherein the variant polypeptide is a mutant selected from one or more mutations shown in Table 43.

15. The method of claim 11, wherein the variant polypeptide is immobilized on a solid support.

16. The method of claim 11, wherein the variant polypeptide is a chimeric polypeptide.

* * * * *

UNITED STATES PATENT AND TRADEMARK OFFICE
CERTIFICATE OF CORRECTION

PATENT NO. : 8,785,162 B2  
APPLICATION NO. : 12/811491  
DATED : July 22, 2014  
INVENTOR(S) : De Souza et al.

Page 1 of 1

It is certified that error appears in the above-identified patent and that said Letters Patent is hereby corrected as shown below:

In the Claims

Column 290, line 26, claim 11, delete "mat least" and insert -- (i) at least --, therefor.

Signed and Sealed this
Fourth Day of November, 2014

Michelle K. Lee
*Deputy Director of the United States Patent and Trademark Office*